(12) United States Patent
Neilan et al.

(10) Patent No.: US 11,130,784 B2
(45) Date of Patent: Sep. 28, 2021

(54) RECOMBINANT MICROCYSTIN PRODUCTION

(71) Applicant: NewSouth Innovations Pty Limited, New South Wales (AU)

(72) Inventors: Brett Neilan, New South Wales (AU); Tianzhe Liu, New South Wales (AU); Rabia Mazmouz, New South Wales (AU); Sarah Ongley, New South Wales (AU)

(73) Assignee: NewSouth Innovations Pty Ltd, New South Wales (AU)

( * ) Notice: Subject to any disclaimer, the term of this patent is extended or adjusted under 35 U.S.C. 154(b) by 0 days.

(21) Appl. No.: 16/336,841

(22) PCT Filed: Oct. 17, 2017

(86) PCT No.: PCT/AU2017/000221
§ 371 (c)(1),
(2) Date: Mar. 26, 2019

(87) PCT Pub. No.: WO2018/071954
PCT Pub. Date: Apr. 26, 2018

(65) Prior Publication Data
US 2019/0263868 A1  Aug. 29, 2019

(30) Foreign Application Priority Data

Oct. 17, 2016 (AU) .................................. 2016904211

(51) Int. Cl.
| C12P 21/02 | (2006.01) |
| C12N 15/52 | (2006.01) |
| C07K 7/56 | (2006.01) |
| C07K 14/405 | (2006.01) |
| C12N 15/00 | (2006.01) |

(52) U.S. Cl.
CPC .............. C07K 7/56 (2013.01); C07K 14/405 (2013.01); C12N 15/00 (2013.01)

(58) Field of Classification Search
CPC ....... C12P 21/02; C07K 14/195; C12N 15/52; C12N 9/12; C12N 9/1288; C12Y 207/08009
See application file for complete search history.

(56) References Cited

FOREIGN PATENT DOCUMENTS

| CN | 101974632 | 5/2012 |
| WO | 2002/068613 | 9/2002 |

OTHER PUBLICATIONS

Copp et al. 2007; characterization of PPTNS, a cyantobacterial phosphopanetheinyl transferase from Nodularia spumigena NAOR10. J. Bacteriol. 189(8): 3133-3139.*
Chistiansen et al. 2003; Microcystin biosynthesis in Planktothrixa: Genes, evolution, and manipulation. J. Bacteriol. 185(2): 564-572.*
Dittmann et al. 2012; Cyanobacterial toxins: biosynthesis and evolutionary roots. FEMS Microbio. Rev. 37:23-43.*
Nishizawa et al. 2000; Polyketide synthase gene couple to the peptide synthase module involved in the biosynthesis of the cyclic hepta-peptide microcystin. K. Biochem. 127:779-789.*
Tillett et al. 2000; Structural organization of microcystin biosynthesis in Microcystis aeruginosa PCC7806: an integrated peptide-polyketide synthetase system. Chemistry & Biology. 7: 752-764.*
International Search Report and Written Opinion corresponding to International Application No. PCT/AU2017/000221 dated Nov. 14, 2017.
International Preliminary Report on Patentability corresponding to International Application No. PCT/AU2017/000221 dated Aug. 27, 2018.
Liu et al. "Directing the Heterologous Production of Specific Cyanobacterial Toxin Variants", ACS Chemical Biology 12:2021-2029 (2017).
Nishizawa et al. "Cyclic heptapeptide microcystin biosynthesis requires the glutamate racemase gene", Microbiology 147:1235-1241 (2001).
Pearson et al. "Characterization of the 2-Hydroxy-acid Dehydrogenase Mcyl, Encoding within the Microsystin Biosynthesis Gene Cluster of Microcystis aeruginosa PCC7806"; J. Biol. Chem. 282:4681-4692 (2007).

* cited by examiner

*Primary Examiner* — Karen Cochrane Carlson
(74) *Attorney, Agent, or Firm* — Myers Bigel, P.A.

(57) ABSTRACT

The present invention relates generally to methods for producing microcystin and recombinant cells capable of producing microcystin. The recombinant cells express exogenous microcystin synthase polypeptides under the control of an exogenous promoter, and further express an exogenous phosphopantethienyl transferase (PPTase). The present invention further relates to microcystin as produced in recombinant cells by the methods described herein.

21 Claims, 8 Drawing Sheets
Specification includes a Sequence Listing.

RECOMBINANT MICROCYSTIN PRODUCTION

INCORPORATION BY CROSS-REFERENCE

The present application is a 35 U.S.C. § 371 national phase application of PCT Application PCT/AU2017/000221 filed Oct. 17, 2017, which claims priority from Australian provisional patent application number 2016904211 filed on 17 Oct. 2016, the entire contents of which are incorporated herein by cross-reference in its entirety.

STATEMENT REGARDING ELECTRONIC FILING OF A SEQUENCE LISTING

A Sequence Listing in ASCII text format, submitted under 37 C.F.R. § 1.821, entitled 9875-15_ST25.txt, 14,292 bytes in size, generated on Mar. 19, 2019 and filed via EFS-Web, is provided in lieu of a paper copy. This Sequence Listing is hereby incorporated by reference into the specification for its disclosures.

TECHNICAL FIELD

The present invention relates generally to methods for producing microcystin and recombinant cells capable of producing microcystin. The present invention further relates to microcystin as produced in recombinant cells by the methods described herein.

BACKGROUND

The production of toxins by cyanobacteria ("blue-green algae") in freshwater bodies has significant health implications for vertebrate species.

The microcystins are the largest and most structurally diverse of the cyanobacterial toxins. Microcystins are hepatotoxins produced by specific members of certain cyanobacterial species including *Microcystis, Nodularia, Dolichospermum* (previous *Anabaena*), *Oscillatoria, Planktothrix, Hapalosiphon, Phormidium* and *Nostoc*. They are monocyclic heptapeptides with seven amino acids, containing D-alanine (Ala) at position one, a variable L-amino acid at each of positions 2 and 4, D-β-methylaspartic acid (MeAsp) at position 3, (2S,3S,8S,9S)-3-amino-9-methoxy-2,6,8-trimethyl-10-phenyldeca-4,6-dienoic acid (Adda) at position 5, iso-linked D-glutamic acid (Glu) position 6, and N-methyl dehydroalanine (MDha) at position 7. Structural variations occur in all seven of the amino acid peptides, and most frequently at the variable positions 2 and 4 (e.g. leucine (L), arginine (R) and tyrosine (Y) at position 2, arginine (R) and alanine (A) at position 4). Different forms of microcystin are typically named according to the L-amino acids present at the two main variable positions (i.e. at positions 2 and 4). For example, the most abundant and toxic form microcystin-LR has a leucine (L) at position 2 and an arginine (R) at position 4.

Over 100 isoforms of microcystin have been isolated from different species of cyanobacteria, varying by degree of methylation, hydroxylation, epimerization, peptide sequence and/or toxicity. The genes responsible for microcystin production in *M. aeruginosa* PCC 7806 are clustered and span 55 kb. Comprising ten genes, the pathway is transcribed as two divergent operons, mcyC-mcyA and mcyD-mcyJ, encoding one polyketide synthase (PKS), three non-ribosomal peptide synthetases (NRPS), and two hybrid PKS-NRPSs.

Microcystins are the most commonly occurring freshwater cyanotoxins globally causing acute poisoning and chronically inducing severe liver damage and hepatocarcinoma. They are primarily taken up into the liver by the multispecific active transport system for bile acids. Once inside the cells, they bind covalently to cytosolic proteins resulting in their retention in the liver. Apart from their adverse impacts on the liver, microcystins also affect the heart, gastrointestinal tract, nervous system, and immune system, and have been shown to exhibit genotoxicity. They are also considered a potential carcinogen for animals, in particular via inhibition of protein phosphatases in humans leading to hyper-phosphorylation of cellular proteins.

Microcystin-containing blooms are an issue worldwide in countries including Australia, Brazil, China, Europe, United States and South Africa. Apart from bioaccumulation in aquatic animals consumed by humans (i.e. seafood) microcystins have become widely disseminated in drinking water sources as a consequence of eutrophication, which has seriously impaired drinking water quality.

Advances in the detection and toxicological study of microcystins are thus essential but have been hindered by the limited availability of microcystins and the high cost of toxin standards.

A need exists for reliable and economically-viable systems to produce microcystin as an alternative to isolating the toxin from slow-growing cyanobacterial cultures. A further need exists for systems that can be tailored towards the production multiple different forms of microcystin in a straightforward manner.

SUMMARY

The present inventors have devised a system for heterologous expression of recombinant microcystin synthetases in *Escherichia coli*. The expression platform described herein can be tailored to heterologously produce a wide variety of microcystin isoforms and variants thereof, in a targeted and economically efficient way. The present invention thus addresses one or several needs existing in the prior art.

Non-limiting embodiments of the present invention are listed below:

Embodiment 1: A recombinant cell for producing microcystin comprising: (i) one or more exogenous polynucleotides encoding any one or more microcystin polypeptides selected from: a microcystin A polypeptide (mcyA), a microcystin B polypeptide (mcyB), a microcystin C polypeptide (mcyC), a microcystin D polypeptide (mcyD), a microcystin E polypeptide (mcyE), a microcystin F polypeptide (mcyF), a microcystin G polypeptide (mcyG), a microcystin H polypeptide (mcyH), a microcystin I polypeptide (mcyI), a microcystin J polypeptide (mcyJ), a microcystin T polypeptide (mcyT), a microcystin L polypeptide (mcyL); (ii) an exogenous promoter operably connected with at least one of the polynucleotides; and (iii) an exogenous phosphopantethienyl transferase (PPT).

Embodiment 2: The recombinant cell according to embodiment 1, wherein the one or more exogenous polynucleotides encode/s each of: a microcystin A polypeptide (mcyA), a microcystin B polypeptide (mcyB), a microcystin C polypeptide (mcyC), a microcystin D polypeptide (mcyD), a microcystin E polypeptide (mcyE), a microcystin G polypeptide (mcyG), a microcystin H polypeptide (mcyH), and a microcystin J polypeptide (mcyJ); and optionally any one or more of: a microcystin F polypeptide (mcyF), a microcystin I polypeptide (mcyI), a microcystin T polypeptide (mcyT), a microcystin L polypeptide (mcyL).

Embodiment 3: The recombinant cell according to embodiment 1, wherein the one or more exogenous polynucleotides encode/s each of: a microcystin A polypeptide (mcyA), a microcystin B polypeptide (mcyB), a microcystin C polypeptide (mcyC), a microcystin D polypeptide (mcyD), a microcystin E polypeptide (mcyE), a microcystin F polypeptide (mcyF), a microcystin G polypeptide (mcyG), a microcystin H polypeptide (mcyH), a microcystin I polypeptide (mcyI), and a microcystin J polypeptide (mcyJ); or A microcystin A polypeptide (mcyA), a microcystin B polypeptide (mcyB), a microcystin C polypeptide (mcyC), a microcystin D polypeptide (mcyD), a microcystin E polypeptide (mcyE), a microcystin G polypeptide (mcyG), a microcystin H polypeptide (mcyH), a microcystin I polypeptide (mcyI), and a microcystin J polypeptide (mcyJ).

Embodiment 4: The recombinant cell according to any one of embodiments 1 to 3, wherein the one or more exogenous polynucleotides comprise/s a nucleotide sequence with at least 60%, at least 70%, at least 75%, at least 80%, at least 85%, at least 90%, or at least 95% sequence identity to: an mcyF gene sequence shown in GenBank accession number JQ290096.1 (SEQ ID NO:69), JQ290086.1 (SEQ ID NO:70), AF183408.1 (SEQ ID NO:71), AY212249.1 (SEQ ID NO:72), AB032549.2 (SEQ ID NO:73), or KC699835.1 (SEQ ID NO:74); and/or an mcyI gene sequence shown in GenBank accession number JQ290099.1 (SEQ ID NO:75), JQ290089.1 (SEQ ID NO:76), AF183408.1 (SEQ ID NO:71), AY212249.1 (SEQ ID NO:72), AB032549.2 (SEQ ID NO:73) or KC699835.1 (SEQ ID NO:74).

Embodiment 5: The recombinant cell according to embodiment 1, wherein the one or more exogenous polynucleotides encode/s each of: (i) a microcystin A polypeptide (mcyA), a microcystin B polypeptide (mcyB), a microcystin C polypeptide (mcyC), a microcystin D polypeptide (mcyD), a microcystin E polypeptide (mcyE), a microcystin G polypeptide (mcyG), a microcystin H polypeptide (mcyH), a microcystin J polypeptide (mcyJ), and a microcystin T polypeptide (mcyT); or (ii) a microcystin A polypeptide (mcyA), a microcystin B polypeptide (mcyB), a microcystin C polypeptide (mcyC), a microcystin D polypeptide (mcyD), a microcystin E polypeptide (mcyE), a microcystin F polypeptide (mcyF), a microcystin G polypeptide (mcyG), a microcystin H polypeptide (mcyH), and a microcystin L polypeptide (mcyL).

Embodiment 6: The recombinant cell according to any one of embodiments 1, 2 or 5, wherein the one or more exogenous polynucleotides comprise/s a nucleotide sequence with at least 60%, at least 70%, at least 75%, at least 80%, at least 85%, at least 90%, or at least 95% sequence identity to: an mcyT gene sequence shown in GenBank accession number EU266362.1 (SEQ ID NO:77) or AJ441056.1 (SEQ ID NO:78); and/or an mcyL gene sequence shown in GenBank accession number KC699835.1 (SEQ ID NO:74).

Embodiment 7: The recombinant cell of any one of embodiments 1 to 6, wherein the one or more exogenous polynucleotides comprise/s a nucleotide sequence with at least 60%, at least 70%, at least 75%, at least 80%, at least 85%, at least 90%, or at least 95% sequence identity to: an mcyA gene sequence in GenBank accession number JQ290083.1 (SEQ ID NO:79), JQ290093.1 (SEQ ID NO:80), AB019578.2 (SEQ ID NO:81), AF183408.1 (SEQ ID NO:71), AY212249.1 (SEQ ID NO:72), AJ441056.1 (SEQ ID NO:78) or KC699835.1 (SEQ ID NO:74); and/or an mcyB gene sequence shown in GenBank accession number JQ290092.1 (SEQ ID NO:82), AY034602.1 (SEQ ID NO:83), AB019578.2 (SEQ ID NO:81), AF183408.1 (SEQ ID NO:71), AY212249.1 (SEQ ID NO:72), AJ441056.1 (SEQ ID NO:78) or KC699835.1 (SEQ ID NO:74); and/or an mcyC gene sequence shown in GenBank accession number JQ290083.1 (SEQ ID NO:79), JQ290091.1 (SEQ ID NO:84), AB019578.2 (SEQ ID NO:81), AF183408.1 (SEQ ID NO:71), AY212249.1 (SEQ ID NO:72), AJ441056.1 (SEQ ID NO:78) or KC699835.1 (SEQ ID NO:74); and/or an mcyD gene sequence shown in GenBank accession number JQ290094.1 (SEQ ID NO:85), JQ290084.1 (SEQ ID NO:86), AF183408.1 (SEQ ID NO:71), AY212249.1 (SEQ ID NO:72), AJ441056.1 (SEQ ID NO:78), AB032549.2 (SEQ ID NO:73) or KC699835.1 (SEQ ID NO:74); and/or an mcyE gene sequence shown in GenBank accession number JQ290095.1 (SEQ ID NO:87), JQ290085.1 (SEQ ID NO:88), AF183408.1 (SEQ ID NO:71), AY212249.1 (SEQ ID NO:72), AJ441056.1 (SEQ ID NO:78), AB032549.2 (SEQ ID NO:73) or KC699835.1 (SEQ ID NO:74); and/or an mcyG gene sequence shown in GenBank accession number JQ290097.1 (SEQ ID NO:89), JQ290087.1 (SEQ ID NO:90), AF183408.1 (SEQ ID NO:71), AY212249.1 (SEQ ID NO:72), AJ441056.1 (SEQ ID NO:78), AB032549.2 (SEQ ID NO:73) or KC699835.1 (SEQ ID NO:74); and/or an mcyH gene sequence shown in GenBank accession number JQ290098.1 (SEQ ID NO:91), JQ290088.1 (SEQ ID NO:82). AF183408.1 (SEQ ID NO:71), AY212249.1 (SEQ ID NO:72), AJ441056.1 (SEQ ID NO:78), AB032549.2 (SEQ ID NO:73) or KC699835.1 (SEQ ID NO:74); and/or an mcyJ gene sequence shown in GenBank accession number JQ290100.1 (SEQ ID NO:93), JQ290090.1 (SEQ ID NO:94), AB254436.1 (SEQ ID NO:95), AF183408.1 (SEQ ID NO:71), AY212249.1 (SEQ ID NO:72), AJ441056.1 (SEQ ID NO:78), AB032549.2 (SEQ ID NO:73) or KC699835.1 (SEQ ID NO:74).

Embodiment 8: The recombinant cell according to any one of embodiments 1 to 7 comprising multiple exogenous polynucleotides, wherein: the polynucleotides are separated from each other by intervening nucleotides; and each of the exogenous polynucleotides encodes distinct microcystin polypeptide/s.

Embodiment 9: The recombinant cell of embodiment 8 comprising: a first exogenous polynucleotide encoding each of: (i) a microcystin A polypeptide (mcyA), a microcystin B polypeptide (mcyB), a microcystin C polypeptide (mcyC); a second exogenous polynucleotide encoding each of: a microcystin D polypeptide (mcyD), a microcystin E polypeptide (mcyE), a microcystin F polypeptide (mcyF), a microcystin G polypeptide (mcyG), a microcystin H polypeptide (mcyH), a microcystin I polypeptide (mcyI), a microcystin J polypeptide (mcyJ); or (ii) a first exogenous polynucleotide encoding each of: a microcystin A polypeptide (mcyA), a microcystin B polypeptide (mcyB), a microcystin C polypeptide (mcyC); a second exogenous polynucleotide encoding: a microcystin J polypeptide (mcyJ); a third exogenous polynucleotide encoding each of: a microcystin D polypeptide (mcyD), a microcystin E polypeptide (mcyE), a microcystin G polypeptide (mcyG), a microcystin H polypeptide (mcyH); a fourth exogenous polynucleotide encoding: a microcystin T polypeptide (mcyT); or (iii) a first exogenous polynucleotide encoding each of: a microcystin A polypeptide (mcyA), a microcystin B polypeptide (mcyB), a microcystin C polypeptide (mcyC); a second exogenous polynucleotide encoding each of: a microcystin G polypeptide (mcyG); a microcystin D polypeptide (mcyD), a microcystin E polypeptide (mcyE), a microcystin F polypeptide (mcyF), a microcystin L polypeptide (mcyL), a microcystin H polypeptide (mcyH).

Embodiment 10: The recombinant cell according to embodiment 8 or embodiment 9, wherein the intervening nucleotides are the exogenous promoter.

Embodiment 11: The recombinant cell according to any one of embodiments 1 to 7 comprising a single exogenous polynucleotide encoding each of the microcystin polypeptide/s.

Embodiment 12: The recombinant cell according to any one of embodiments 1 to 11, wherein the exogenous polynucleotides are DNA.

Embodiment 13: The recombinant cell according to any one of embodiments 1 to 12, wherein the exogenous promoter is one or more of: an inducible promoter, an antibiotic-inducible promoter, a tetracycline-inducible promoter.

Embodiment 14: The recombinant cell of any one of embodiments 1 to 13, wherein the exogenous promoter is a processive promoter capable of facilitating production of mRNA transcripts of at least 5 kb, at least 10 kb, at least 15 kb, at least 20 k, at least 25 kb, at least 30 kb, or at least 35 kb in length.

Embodiment 15: The recombinant cell of any one of embodiments 1 to 14, wherein the exogenous promoter is a bi-directional promoter.

Embodiment 16: The recombinant cell according to embodiment 15, wherein the exogenous promoter is a bi-directional promoter operably linked to the first and second exogenous polynucleotides.

Embodiment 17: The recombinant cell according to any one of embodiments 1 to 16, wherein the exogenous promoter is $Ptet_O$.

Embodiment 18: The recombinant cell according to any one of embodiments 1 to 17, wherein the exogenous PPT is capable of activating type I and type II acyl carrier proteins (ACP) and peptidyl carrier proteins (PCP).

Embodiment 19: The recombinant cell according to any one of embodiments 1 to 17, wherein the PPT is a bacterial PPT.

Embodiment 20: The recombinant cell according to embodiment 19, wherein the bacterial PPT is a cyanobacterial, *Bacillus* sp. (e.g. *Bacillus subtilis*), myxobacterial, actinobacterial (e.g. *Streptomyces* sp.), or *Pseudomonas* sp. PPT.

Embodiment 21: The recombinant cell according to embodiment 20, wherein the cyanobacterial PPT is a *Nodularia* sp. (e.g. *Nodularia spumigena*, *Nodularia spumigena* NSOR10) PPT.

Embodiment 22: The recombinant cell according to embodiment 20, wherein the myxobacterial PPT is a *Stigmatella* sp. (e.g. *Stigmatella aurantiaca*, *Stigmatella aurantiaca* DW4/3-1) PPT.

Embodiment 23: The recombinant cell according to embodiment 22, wherein the PPT is a *Stigmatella aurantiaca* DW4/3-1 MtaA PPT.

Embodiment 24: The recombinant cell according to any one of embodiments 1 to 23 comprising an exogenous polynucleotide sequence encoding the PPT.

Embodiment 25: The recombinant cell according to any one of embodiments 1 to 24 comprising an exogenous polynucleotide sequence encoding the PPT that is integrated into the recombinant cell genome.

Embodiment 26: The recombinant cell according to any one of embodiments 1 to 25, further comprising an exogenous polynucleotide sequence encoding an amino acid and/or a hydroxyacid for incorporation into the microcystin.

Embodiment 27: The recombinant cell according to any one of embodiments 1 to 25, wherein the cell is a recombinant prokaryotic cell.

Embodiment 28: The recombinant cell according to any one of embodiments 1 to 27, wherein the cell is a recombinant bacterial cell.

Embodiment 29: The recombinant cell according to any one of embodiments 1 to 28, wherein the cell is a recombinant Enterobacteriaceae family cell.

Embodiment 30: The recombinant cell according to any one of embodiments 1 to 29, wherein the cell is a recombinant *Escherichia* sp. cell.

Embodiment 31: The recombinant cell according to any one of embodiments 1 to 30, wherein the cell is a recombinant *E. coli* cell.

Embodiment 32: The recombinant cell according to any one of embodiments 1 to 31, wherein the recombinant cell is not: a eukaryotic cell, a cyanobacterium, a dinoflagellate, a yeast, a human cell, a mammalian cell, a plant cell.

Embodiment 33: The recombinant cell according to any one of embodiments 1 to 32, wherein the recombinant cell does not comprise genetic material encoding: additional cyanotoxin/s, any one or more of cylindrospermopsin, anatoxin, homoanatoxin, saxitoxin, neosaxitoxin, lyngbyatoxin, aplysiatoxin, and/or nodularin.

Embodiment 34: A method for producing microcystin, the method comprising: culturing the recombinant cell according to any one of embodiments 1 to 33 in a suitable culture medium suitable and for a suitable time period to facilitate production of the microcystin.

Embodiment 35: The method according to embodiment 34, further comprising isolating the microcystin produced by the cells during or following the culturing.

Embodiment 36: The method according to embodiment 34 or embodiment 35, further comprising adding an amino acid and/or a hydroxyacid into the culture medium, wherein the amino acid and/or hydroxyacid is/are incorporated into the microcystin produced by the recombinant cell.

Embodiment 37: The method according to embodiment 36, wherein the amino acid and/or a hydroxyacid is not endogenously produced by the recombinant cell.

Embodiment 38: The method according to any one of embodiments 34 to 37, wherein the recombinant cell comprises an inducible promoter, and the method further comprises adding a compound to the culture medium that activates the inducible promoter.

Embodiment 39: The method according to any one of embodiments 34 to 38, wherein the microcystin is microcystin LA, microcystin LL, microcystin AR, microcystin YA, microcystin LM, microcystin VF, microcystin YM, microcystin LF, microcystin LR, [D-Asp$^3$]microcystin-LR, microcystin LW, microcystin FR, microcystin WR, microcystin LY, microcystin RR, or microcystin YR.

Embodiment 40: A method for generating a recombinant cell capable of producing microcystin, the method comprising transforming a parent cell with: (i) one or more exogenous microcystin (mcy) polynucleotides encoding any one or more microcystin polypeptides selected from: a microcystin A polypeptide (mcyA), a microcystin B polypeptide (mcyB), a microcystin C polypeptide (mcyC), a microcystin D polypeptide (mcyD), a microcystin E polypeptide (mcyE), a microcystin F polypeptide (mcyF), a microcystin G polypeptide (mcyG), a microcystin H polypeptide (mcyH), a microcystin I polypeptide (mcyI), a microcystin J polypeptide (mcyJ), a microcystin T polypeptide (mcyT), a microcystin L polypeptide (mcyL); (ii) an exogenous promoter operably connected with at least one of the mcy polynucleotides; and (iii) an exogenous polynucleotide sequence encoding a phosphopantethienyl transferase (PPT).

Embodiment 41: The method according to embodiment 40, wherein the one or more exogenous mcy polynucleotides encode/s each of: a microcystin A polypeptide (mcyA), a microcystin B polypeptide (mcyB), a microcystin C polypeptide (mcyC), a microcystin D polypeptide (mcyD), a microcystin E polypeptide (mcyE), a microcystin G polypeptide (mcyG), a microcystin H polypeptide (mcyH), and a microcystin J polypeptide (mcyJ), a microcystin L polypeptide (mcyL); and optionally any one or more of: a microcystin F polypeptide (mcyF), a microcystin I polypeptide (mcyI), a microcystin T polypeptide (mcyT).

Embodiment 42: The method according to embodiment 41, wherein the one or more exogenous mcy polynucleotides encode/s each of: a microcystin A polypeptide (mcyA), a microcystin B polypeptide (mcyB), a microcystin C polypeptide (mcyC), a microcystin D polypeptide (mcyD), a microcystin E polypeptide (mcyE), a microcystin F polypeptide (mcyF), a microcystin G polypeptide (mcyG), a microcystin H polypeptide (mcyH), a microcystin I polypeptide (mcyI), and a microcystin J polypeptide (mcyJ); or a microcystin A polypeptide (mcyA), a microcystin B polypeptide (mcyB), a microcystin C polypeptide (mcyC), a microcystin D polypeptide (mcyD), a microcystin E polypeptide (mcyE), a microcystin G polypeptide (mcyG), a microcystin H polypeptide (mcyH), a microcystin I polypeptide (mcyI), and microcystin J polypeptide (mcyJ).

Embodiment 43: The method according to any one of embodiments 40 to 42, wherein the one or more exogenous mcy polynucleotides comprise/s a nucleotide sequence with at least 60%, at least 70M, at least 75%, at least 80%, at least 85%, at least 90%, or at least 95% sequence identity to: an mcyF gene sequence shown in GenBank accession number JQ290096.1 (SEQ ID NO:69), JQ290086.1 (SEQ ID NO:70), AF183408.1 (SEQ ID NO:71), AY212249.1 (SEQ ID NO:72), AB032549.2 (SEQ ID NO:73), or KC699835.1 (SEQ ID NO:74); and/or an mcyI gene sequence shown in GenBank accession number JQ290099.1 (SEQ ID NO:75), JQ290089.1 (SEQ ID NO:76), AF183408.1 (SEQ ID NO:71), AY212249.1 (SEQ ID NO:72), AB032549.2 (SEQ ID NO:73) or KC699835.1 (SEQ ID NO:74).

Embodiment 44: The method according to embodiment 40, wherein the one or more exogenous mcy polynucleotides encode/s each of: (i) a microcystin A polypeptide (mcyA), a microcystin B polypeptide (mcyB), a microcystin C polypeptide (mcyC), a microcystin D polypeptide (mcyD), a microcystin E polypeptide (mcyE), a microcystin G polypeptide (mcyG), a microcystin H polypeptide (mcyH), a microcystin J polypeptide (mcyJ), and a microcystin T polypeptide (mcyT); or (ii) a microcystin A polypeptide (mcyA), a microcystin B polypeptide (mcyB), a microcystin C polypeptide (mcyC), a microcystin D polypeptide (mcyD), a microcystin E polypeptide (mcyE), a microcystin F polypeptide (mcyF), a microcystin G polypeptide (mcyG), a microcystin H polypeptide (mcyH), and a microcystin L polypeptide (mcyL).

Embodiment 45: The method according to any one of embodiments 40, 41 or 44, wherein the one or more exogenous mcy polynucleotides comprise/s a nucleotide sequence with at least 60%, at least 70%, at least 75%, at least 80%, at least 85%, at least 90%, or at least 95% sequence identity to: an mcyT gene sequence shown in GenBank accession number EU266362.1 (SEQ ID NO:77) or AJ441056.1 (SEQ ID NO:78); and/or an mcyL gene sequence shown in GenBank accession number KC699835.1 (SEQ ID NO:74).

Embodiment 46: The method of any one of embodiments 40 to 45, wherein the one or more exogenous mcy polynucleotides comprise/s a nucleotide sequence with at least 60%, at least 70%, at least 75%, at least 80%, at least 85%, at least 90%, or at least 95% sequence identity to: an mcyA gene sequence shown in GenBank accession number JQ290083.1 (SEQ ID NO:79), JQ290093.1 (SEQ ID NO:80), AB019578.2 (SEQ ID NO:81), AF183408.1 (SEQ ID NO:71), AY212249.1 (SEQ ID NO:72), AJ441056.1 (SEQ ID NO:78) or KC699835.1 (SEQ ID NO:74); and/or an mcyB gene sequence shown in GenBank accession number JQ290092.1 (SEQ ID NO:82), AY034602.1 (SEQ ID NO:83), AB019578.2 (SEQ ID NO:81), AF183408.1 (SEQ ID NO:71), AY212249.1 (SEQ ID NO:72), AJ441056.1 (SEQ ID NO:78) or KC699835.1 (SEQ ID NO:74); and/or an mcyC gene sequence shown in GenBank accession number JQ290083.1 (SEQ ID NO:79), JQ290091.1 (SEQ ID NO:84), AB019578.2 (SEQ ID NO:81), AF183408.1 (SEQ ID NO:71), AY212249.1 (SEQ ID NO:72), AJ441056.1 (SEQ ID NO:78) or KC699835.1 (SEQ ID NO:74); and/or an mcyD gene sequence shown in GenBank accession number JQ290094.1 (SEQ ID NO:85), JQ290084.1 (SEQ ID NO:86), AF183408.1 (SEQ ID NO:71), AY212249.1 (SEQ ID NO:72), AJ441056.1 (SEQ ID NO:78), AB032549.2 (SEQ ID NO:73) or KC699835.1 (SEQ ID NO:74); and/or an mcyE gene sequence shown in GenBank accession number JQ290095.1 (SEQ ID NO:87), JQ290085.1 (SEQ ID NO:88), AF183408.1 (SEQ ID NO:71), AY212249.1 (SEQ ID NO:72), AJ441056.1 (SEQ ID NO:78), AB032549.2 (SEQ ID NO:73) or KC699835.1 (SEQ ID NO:74); and/or an mcyG gene sequence shown in GenBank accession number JQ290097.1 (SEQ ID NO:89), JQ290087.1 (SEQ ID NO:90), AF183408.1 (SEQ ID NO:71), AY212249.1 (SEQ ID NO:72), AJ441056.1 (SEQ ID NO:78), AB032549.2 (SEQ ID NO:73) or KC699835.1 (SEQ ID NO:74); and/or an mcyH gene sequence shown in GenBank accession number JQ290098.1 (SEQ ID NO:91), JQ290088.1 (SEQ ID NO:82), AF183408.1 (SEQ ID NO:71), AY212249.1 (SEQ ID NO:72), AJ441056.1 (SEQ ID NO:78), AB032549.2 (SEQ ID NO:73) or KC699835.1 (SEQ ID NO:74); and/or an mcyJ gene sequence shown in GenBank accession number JQ290100.1 (SEQ ID NO:93), JQ290090.1 (SEQ ID NO:94), AB254436.1 (SEQ ID NO:95), AF183408.1 (SEQ ID NO:71), AY212249.1 (SEQ ID NO:72), AJ441056.1 (SEQ ID NO:78), AB032549.2 (SEQ ID NO:73) or KC699835.1 (SEQ ID NO:74).

Embodiment 47: The method according to any one of embodiments 40 to 46, comprising transforming parent cell with multiple exogenous mcy polynucleotides, wherein: the mcy polynucleotides are separated from each other by intervening nucleotides; and each of the exogenous mcy polynucleotides encode distinct microcystin polypeptide/s.

Embodiment 48: The method of embodiment 47, comprising transforming parent cell with: a first exogenous polynucleotide encoding each of: (i) a microcystin A polypeptide (mcyA), a microcystin B polypeptide (mcyB), a microcystin C polypeptide (mcyC); a second exogenous polynucleotide encoding each of: a microcystin D polypeptide (mcyD), a microcystin E polypeptide (mcyE), a microcystin F polypeptide (mcyF), a microcystin G polypeptide (mcyG), a microcystin H polypeptide (mcyH), a microcystin I polypeptide (mcyI), a microcystin J polypeptide (mcyJ); or (ii) a first exogenous polynucleotide encoding each of: a microcystin A polypeptide (mcyA), a microcystin B polypeptide (mcyB), a microcystin C polypeptide (mcyC); a second exogenous polynucleotide encoding: a microcystin J polypeptide (mcyJ); a third exogenous polynucleotide encoding each of: a microcystin D polypeptide (mcyD), a microcystin E polypeptide (mcyE), a microcystin G polypeptide (mcyG), a microcystin H polypeptide (mcyH); a fourth exogenous polynucleotide encoding: a microcystin T polypeptide (mcyT); or (iii) a first exogenous polynucleotide encoding each of: a microcystin A polypeptide (mcyA), a microcystin B polypeptide (mcyB), a microcystin C polypeptide (mcyC); a second exogenous polynucleotide encoding each of: a microcystin G polypeptide (mcyG), a microcystin D polypeptide (mcyD), a microcystin E polypeptide (mcyE), a microcystin F polypeptide (mcyF), a microcystin L polypeptide (mcyL), a microcystin H polypeptide (mcyH), wherein: each said exogenous mcy polynucleotide is separated from the other exogenous polynucleotide/s by intervening nucleotides; and each said exogenous mcy polynucleotide encodes a distinct microcystin polypeptide.

Embodiment 49: The method according to embodiment 47 or embodiment 48, wherein the intervening nucleotides are the exogenous promoter.

Embodiment 50: The method according to any one of embodiments 40 to 49, comprising transforming parent cell with a single exogenous mcy polynucleotide encoding each of the microcystin polypeptide/s.

Embodiment 51: The method according to any one of embodiments 40 to 50, wherein the exogenous mcy polynucleotides are DNA.

Embodiment 52: The method according to any one of embodiments 40 to 51, wherein the exogenous promoter is one or more of: an inducible promoter, an antibiotic-inducible promoter, a tetracycline-inducible promoter.

Embodiment 53: The method of any one of embodiments 40 to 52, wherein the exogenous promoter is a processive promoter capable of facilitating production of mRNA transcripts of at least 5 kb, at least 10 kb, at least 15 kb, at least 20 k, at least 25 kb, at least 30 kb, or at least 35 kb in length.

Embodiment 54: The method of any one of embodiments 40 to 53, wherein the exogenous promoter is a bi-directional promoter.

Embodiment 55: The method according to embodiment 54, wherein the exogenous promoter is a bi-directional promoter operably linked to the first and second exogenous polynucleotides.

Embodiment 56: The method according to any one of embodiments 40 to 55, wherein the exogenous promoter is $Ptet_O$.

Embodiment 57: The method according to any one of embodiments 40 to 56, wherein the exogenous PPT is capable of activating type I and type II acyl carrier proteins (ACP) and peptidyl carrier proteins (PCP).

Embodiment 58: The method according to any one of embodiments 40 to 57, wherein the PPT is a bacterial PPT.

Embodiment 59: The method according to embodiment 58, wherein the bacterial PPT is a cyanobacterial, *Bacillus* sp. (e.g. *Bacillus subtilis*), myxobacterial, actinobacterial (e.g. *Streptomyces* sp.), or *Pseudomonas* sp. PPT.

Embodiment 60: The method according to embodiment 59, wherein the cyanobacterial PPT is a *Nodularia* sp. (e.g. *Nodularia spumigena*, *Nodularia spumigena* NSOR10) PPT.

Embodiment 61: The method according to embodiment 59, wherein the myxobacterial PPT is a *Stigmatella* sp. (e.g. *Stigmatella aurantiaca, Stigmatella aurantiaca* DW4/3-1) PPT.

Embodiment 62: The method according to embodiment 61, wherein the PPT is a *Stigmatella aurantiaca* DW4/3-1 MtaA PPT.

Embodiment 63: The method according to any one of embodiments 40 to 62 wherein the PPT is exogenous to the parent cell.

Embodiment 64: The method according to any one of embodiments 40 to 63 wherein the exogenous polynucleotide sequence encoding the PPT is integrated into the parent cell genome.

Embodiment 65: The method according to any one of embodiments 40 to 64, further comprising transforming the parent cell with an exogenous polynucleotide sequence encoding an amino acid and/or a hydroxyacid for incorporation into the microcystin.

Embodiment 66: The method according to any one of embodiments 40 to 65, wherein the parent cell is a prokaryotic cell.

Embodiment 67: The method according to any one of embodiments 40 to 66, wherein the parent cell is a bacterial cell.

Embodiment 68: The method according to any one of embodiments 40 to 67, wherein the parent cell is an Enterobacteriaceae family cell.

Embodiment 69: The method according to any one of embodiments 40 to 68, wherein the parent cell is an *Escherichia* sp. cell.

Embodiment 70: The method according to any one of embodiments 40 to 69, wherein the parent cell is an *E. coli* cell.

Embodiment 71: The method according to any one of embodiments 40 to 70, wherein the parent cell is not: a eukaryotic cell, a cyanobacterium, a dinoflagellate, a yeast, a human cell, a mammalian cell, a plant cell.

Embodiment 72: The method according to any one of embodiments 40 to 71, wherein the parent cell does not comprise genetic material encoding: additional cyanotoxin/s, any one or more of cylindrospermopsin, anatoxin, homoanatoxin, saxitoxin, neosaxitoxin, lyngbyatoxin, aplysiatoxin, and/or nodularin.

Embodiment 73: The method according to any one of embodiments 40 to 72, further comprising propagating the parent cell to produce recombinant progeny cells.

Embodiment 74: Microcystin produced by, obtained by, or obtainable by, the method according to any one of embodiments 34 to 39.

The invention further relates to the following non-limiting embodiments 1-26 as follows:

Embodiment 1: A recombinant cell for producing microcystin comprising:

(i) one or more exogenous polynucleotides encoding any one or more microcystin polypeptides selected from:
 a microcystin A polypeptide (mcyA),
 a microcystin B polypeptide (mcyB),
 a microcystin C polypeptide (mcyC),
 a microcystin D polypeptide (mcyD),
 a microcystin E polypeptide (mcyE),
 a microcystin F polypeptide (mcyF),
 a microcystin G polypeptide (mcyG),
 a microcystin H polypeptide (mcyH),
 a microcystin I polypeptide (mcyI),
 a microcystin J polypeptide (mcyJ),
 a microcystin T polypeptide (mcyT)
 a microcystin L polypeptide (mcyL):

(ii) an exogenous promoter operably connected with at least one of the polynucleotides; and (iii) an exogenous phosphopantethienyl transferase (PPT).

Embodiment 2: A method for generating a recombinant cell capable of producing microcystin, the method comprising transforming a parent cell with:
(i) one or more exogenous polynucleotides encoding any one or more
microcystin polypeptides selected from:
a microcystin A polypeptide (mcyA),
a microcystin B polypeptide (mcyB),
a microcystin C polypeptide (mcyC),
a microcystin D polypeptide (mcyD),
a microcystin E polypeptide (mcyE),
a microcystin F polypeptide (mcyF),
a microcystin G polypeptide (mcyG),
a microcystin H polypeptide (mcyH),
a microcystin I polypeptide (mcyI),
a microcystin J polypeptide (mcyJ),
a microcystin T polypeptide (mcyT),
a microcystin L polypeptide (mcyL):
(ii) an exogenous promoter operably connected with at least one of the mcy polynucleotides; and
(iii) an exogenous polynucleotide sequence encoding a phosphopantethienyl transferase (PPT).

Embodiment 3: The recombinant cell of embodiment 1 or the method of embodiment 2, wherein the one or more exogenous polynucleotides encode/s each of:
a microcystin A polypeptide (mcyA),
a microcystin B polypeptide (mcyB),
a microcystin C polypeptide (mcyC),
a microcystin D polypeptide (mcyD),
a microcystin E polypeptide (mcyE),
a microcystin G polypeptide (mcyG),
a microcystin H polypeptide (mcyH), and
a microcystin J polypeptide (mcyJ);
and optionally any one or more of:
a microcystin F polypeptide (mcyF),
a microcystin I polypeptide (mcyI),
a microcystin T polypeptide (mcyT),
a microcystin L polypeptide (mcyL).

Embodiment 4: The recombinant cell of embodiment 1 or the method of embodiment 2, wherein the one or more exogenous polynucleotides encode/s each of:
a microcystin A polypeptide (mcyA),
a microcystin B polypeptide (mcyB),
a microcystin C polypeptide (mcyC),
a microcystin D polypeptide (mcyD),
a microcystin E polypeptide (mcyE),
a microcystin F polypeptide (mcyF),
a microcystin G polypeptide (mcyG),
a microcystin H polypeptide (mcyH),
a microcystin I polypeptide (mcyI),
a microcystin J polypeptide (mcyJ).

Embodiment 5: The recombinant cell of any one of embodiments 1, 3, or 4, the method of any one of embodiments 2 to 4, wherein the one or more exogenous polynucleotides comprise/s a nucleotide sequence with at least 60%, at least 70%, at least 75%, at least 80%, at least 85%, at least 90%, or at least 95% sequence identity to:
an mcyF gene sequence shown in GenBank accession number JQ290096.1 (SEQ ID NO:69), JQ290086.1 (SEQ ID NO:70), AF183408.1 (SEQ ID NO:71), AY212249.1 (SEQ ID NO:72), AB032549.2 (SEQ ID NO:73), or KC699835.1 (SEQ ID NO:74); and/or
an mcyI gene sequence shown in GenBank accession number JQ290099.1 (SEQ ID NO:75), JQ290089.1 (SEQ ID NO:76), AF183408.1 (SEQ ID NO:71), AY212249.1 (SEQ ID NO:72), AB032549.2 (SEQ ID NO:73), or KC699835.1 (SEQ ID NO:74).

Embodiment 6: The recombinant cell of embodiment 1 or the method of embodiment 2, wherein the one or more exogenous polynucleotides encode/s each of:
(i) a microcystin A polypeptide (mcyA),
a microcystin B polypeptide (mcyB),
a microcystin C polypeptide (mcyC),
a microcystin D polypeptide (mcyD),
a microcystin E polypeptide (mcyE),
a microcystin G polypeptide (mcyG),
a microcystin H polypeptide (mcyH),
a microcystin J polypeptide (mcyJ), and
a microcystin T polypeptide (mcyT); or
(ii) a microcystin A polypeptide (mcyA),
a microcystin B polypeptide (mcyB),
a microcystin C polypeptide (mcyC),
a microcystin D polypeptide (mcyD),
a microcystin E polypeptide (mcyE),
a microcystin F polypeptide (mcyF),
a microcystin G polypeptide (mcyG),
a microcystin H polypeptide (mcyH), and
a microcystin L polypeptide (mcyL).

Embodiment 7: The recombinant cell according to any one of embodiments 1, 3 or 6, or the method according to any one of embodiments 2, 3 or 6, wherein the one or more exogenous polynucleotides comprise/s a nucleotide sequence with at least 60%, at least 70%, at least 75%, at least 80%, at least 85%, at least 90%, or at least 95% sequence identity to:
an mcyT gene sequence shown in GenBank accession number EU266362.1 (SEQ ID NO:77) or AJ441056.1 (SEQ ID NO:78); and/or
an mcyL gene sequence shown in GenBank accession number KC699835.1 (SEQ ID NO:74).

Embodiment 8: The recombinant cell of any one of embodiments 1 or 3 to 7, or the method of any one of embodiments 2 to 7, wherein the one or more exogenous polynucleotides comprise/s a nucleotide sequence with at least 60%, at least 70%, at least 75%, at least 80%, at least 85%, at least 90%, or at least 95% sequence identity to:
an mcyA gene sequence shown in GenBank accession number JQ290083.1 (SEQ ID NO:79), JQ290093.1 (SEQ ID NO:80), AB019578.2 (SEQ ID NO:81), AF183408.1 (SEQ ID NO:71), AY212249.1 (SEQ ID NO:72), AJ441056.1 (SEQ ID NO:78) or KC699835.1 (SEQ ID NO:74); and/or
an mcyB gene sequence shown in GenBank accession number JQ290092.1 (SEQ ID NO:82), AY034602.1 (SEQ ID NO:83), AB019578.2 (SEQ ID NO:81), AF183408.1 (SEQ ID NO:71), AY212249.1 (SEQ ID NO:72), AJ441056.1 (SEQ ID NO:78) or KC699835.1 (SEQ ID NO:74); and/or
an mcyC gene sequence shown in GenBank accession number JQ290083.1 (SEQ ID NO:79), JQ290091.1 (SEQ ID NO:84), AB019578.2 (SEQ ID NO:81), AF183408.1 (SEQ ID NO:71), AY212249.1 (SEQ ID NO:72), AJ441056.1 (SEQ ID NO:78) or KC699835.1 (SEQ ID NO:74): and/or
an mcyD gene sequence shown in GenBank accession number JQ290094.1 (SEQ ID NO:85), JQ290084.1 (SEQ ID NO:86), AF183408.1 (SEQ ID NO:71), AY212249.1 (SEQ ID NO:72), AJ441056.1 (SEQ ID NO:78), AB032549.2 (SEQ ID NO:73) or KC699835.1 (SEQ ID NO:74); and/or
an mcyE gene sequence shown in GenBank accession number JQ290095.1 (SEQ ID NO:87), JQ290085.1 (SEQ ID NO:88), AF183408.1 (SEQ ID NO:71), AY212249.1

(SEQ ID NO:72), AJ441056.1 (SEQ ID NO:78), AB032549.2 (SEQ ID NO:73) or KC699835.1 (SEQ ID NO:74); and/or an mcyG gene sequence shown in GenBank accession number JQ290097.1 (SEQ ID NO:89), JQ290087.1 (SEQ ID NO:90), AF183408.1 (SEQ ID NO:71), AY212249.1 (SEQ ID NO:72), AJ441056.1 (SEQ ID NO:78), AB032549.2 (SEQ ID NO:73) or KC699835.1 (SEQ ID NO:74); and/or an mcyH gene sequence shown in GenBank accession number JQ290098.1 (SEQ ID NO:91), JQ290088.1 (SEQ ID NO:92). AF183408.1 (SEQ ID NO:71), AY212249.1 (SEQ ID NO:72), AJ441056.1 (SEQ ID NO:78), AB032549.2 (SEQ ID NO:73) or KC699835.1 (SEQ ID NO:74); and/or an mcyJ gene sequence shown in GenBank accession number JQ290100.1 (SEQ ID NO:93), JQ290090.1 (SEQ ID NO:94), AB254436.1 (SEQ ID NO:95), AF183408.1 (SEQ ID NO:71), AY212249.1 (SEQ ID NO:72), AJ441056.1 (SEQ ID NO:78), AB032549.2 (SEQ ID NO:73) or KC699835.1 (SEQ ID NO:74).

Embodiment 9: The recombinant cell of any one of embodiments 1 or 3 to 8, comprising multiple exogenous polynucleotides, wherein:

the polynucleotides are separated from each other by intervening nucleotides; and each of the exogenous polynucleotides encodes distinct microcystin polypeptide/s.

Embodiment 10: The method of any one of embodiments 2 to 8, comprising transforming the parent cell with multiple exogenous mcy polynucleotides, wherein:

the mcy polynucleotides are separated from each other by intervening nucleotides; and each of the exogenous mcy polynucleotides encode distinct microcystin polypeptide/s.

Embodiment 1: The recombinant cell of embodiment 9 or the method of embodiment 10 wherein the multiple exogenous polynucleotides comprise:

(i) a first exogenous polynucleotide encoding each of:
 a microcystin A polypeptide (mcyA),
 a microcystin B polypeptide (mcyB),
 a microcystin C polypeptide (mcyC);
a second exogenous polynucleotide encoding each of:
 a microcystin D polypeptide (mcyD),
 a microcystin E polypeptide (mcyE),
 a microcystin F polypeptide (mcyF),
 a microcystin G polypeptide (mcyG),
 a microcystin H polypeptide (mcyH),
 a microcystin I polypeptide (mcyI),
 a microcystin J polypeptide (mcyJ); or
(ii) a first exogenous polynucleotide encoding each of:
 a microcystin A polypeptide (mcyA),
 a microcystin B polypeptide (mcyB),
 a microcystin C polypeptide (mcyC);
a second exogenous polynucleotide encoding:
 a microcystin J polypeptide (mcyJ);
a third exogenous polynucleotide encoding each of:
 a microcystin D polypeptide (mcyD),
 a microcystin E polypeptide (mcyE),
 a microcystin G polypeptide (mcyG),
 a microcystin H polypeptide (mcyH);
a fourth exogenous polynucleotide encoding:
 a microcystin T polypeptide (mcyT); or
(iii) a first exogenous polynucleotide encoding each of:
 a microcystin A polypeptide (mcyA),
 a microcystin B polypeptide (mcyB),
 a microcystin C polypeptide (mcyC);

a second exogenous polynucleotide encoding each of:
 a microcystin G polypeptide (mcyG),
 a microcystin D polypeptide (mcyD),
 a microcystin E polypeptide (mcyE),
 a microcystin F polypeptide (mcyF),
 a microcystin L polypeptide (mcyL),
 a microcystin H polypeptide (mcyH).

Embodiment 12: The recombinant cell of embodiment 9 or embodiment 11, or the method of embodiment 10 or 11, wherein the intervening nucleotides are the exogenous promoter.

Embodiment 13: The recombinant cell according to any one of embodiments 1 or 3 to 8, or the method of any one of embodiments 2 to 8, comprising a single exogenous polynucleotide encoding each of the microcystin polypeptide/s.

Embodiment 14: The recombinant cell of any one of embodiments 1, 3 to 9, or 11 to 13, or the method of any one of embodiments 2 to 8 or 10 to 13, wherein the one or more exogenous polynucleotides are DNA.

Embodiment 15: The recombinant cell of any one of embodiments 1, 3 to 9, or 11 to 14, or the method of any one of embodiments 2 to 8 or 10 to 14, wherein the exogenous promoter:

(i) is not a T7 polymerase promoter; and/or (ii) is one or more of: an inducible promoter, an antibiotic-inducible promoter, a tetracycline-inducible promoter; and/or (iii) is a processive promoter capable of facilitating production of mRNA transcripts of at least 5 kb, at least 10 kb, at least 15 kb, at least 20 k, at least 25 kb, at least 30 kb, or at least 35 kb in length; and/or (iv) is a bi-directional promoter; and/or (v) is a bi-directional promoter operably linked to the first and second exogenous polynucleotides; and/or (vi) is Ptet$_O$.

Embodiment 16: The recombinant cell of any one of embodiments 1, 3 to 9, or 11 to 15, or the method of any one of embodiments 2 to 8 or 10 to 15, wherein the exogenous PPT:

(i) is capable of activating type I and type II acyl carrier proteins (ACP) and peptidyl carrier proteins (PCP); and/or (ii) is a bacterial PPT, a cyanobacterial PPT, a *Bacillus* sp. (e.g. *Bacillus subtilis*) PPT, a myxobacterial PPT, an actinobacterial (e.g. *Streptomyces* sp.) PPT, a *Pseudomonas* sp. PPT, a *Nodularia* sp. (e.g. *Nodularia spumigena, Nodularia spumigena* NSOR10) PPT, a *Stigmatella* sp. (e.g. *Stigmatella aurantiaca, Stigmatella aurantiaca* DW4/3-1) PPT, or a *Stigmatella aurantiaca* DW4/3-1 MtaA PPT.

Embodiment 17: The recombinant cell of any one of embodiments 1, 3 to 9, or 11 to 16, or the method of any one of embodiments 2 to 8 or 10 to 16 comprising;

(i) an exogenous polynucleotide sequence encoding the PPT; and/or (ii) an exogenous polynucleotide sequence encoding the PPT that is integrated into the recombinant cell genome; and/or (iii) an exogenous polynucleotide sequence encoding an amino acid and/or a hydroxyacid for incorporation into the microcystin.

Embodiment 18: The recombinant cell of any one of embodiments 1, 3 to 9, or 1 I to 17, or the method of any one of embodiments 2 to 8 or 10 to 17, wherein the cell is a recombinant prokaryotic cell, a recombinant bacterial cell, a recombinant Enterobacteriaceae family cell, a recombinant *Escherichia* sp. cell, a recombinant *E. coli* cell;

Embodiment 19: The recombinant cell of any one of embodiments 1, 3 to 9, or 11 to 18, or the method of any one of embodiments 2 to 8 or 10 to 18, wherein the cell:
(i) is not:
a eukaryotic cell,
a cyanobacterium,
a dinoflagellate,
a yeast,
a human cell,
a mammalian cell,
a plant cell; and/or
(ii) does not comprise genetic material encoding:
additional cyanotoxin/s,
any one or more of cylindrospermopsin, anatoxin, homoanatoxin, saxitoxin, neosaxitoxin, lyngbyatoxin, erythromycin, aplysiatoxin, and/or nodularin.

Embodiment 20: The recombinant cell of any one of embodiments 1, 3 to 9, or 11 to 19, or the method of any one of embodiments 2 to 8 or 10 to 19, wherein the recombinant cell does not comprise a polynucleotide encoding:
any polyketide that is not a microcystin; and/or
6-deoxyerythronolide B synthase or a catalytic domain thereof (e.g. DEBS1, DEBS2 and/or DEBS3).

Embodiment 21: The recombinant cell of any one of embodiments 1, 3 to 9, or 11 to 20, or the method of any one of embodiments 2 to 8 or 10 to 20, wherein:
(i) the one or more exogenous genes are located within a single plasmid; or
(ii) the one or more exogenous genes are located within a single plasmid capable of conferring resistance to only one antibiotic type.

Embodiment 22: A method for producing microcystin, the method comprising:
culturing the recombinant cell according to any one of embodiments 1, 3 to 9 or 11 to 21 in a suitable culture medium suitable and for a suitable time period to facilitate production of the microcystin,
and optionally isolating the microcystin produced by the cells during or following the culturing.

Embodiment 23: The method according to embodiment 22, further comprising adding an amino acid and/or a hydroxyacid into the culture medium, wherein the amino acid and/or hydroxyacid is/are incorporated into the microcystin produced by the recombinant cell.

Embodiment 24: The method according to embodiment 23, wherein the amino acid and/or a hydroxyacid is not endogenously produced by the recombinant cell.

Embodiment 25: The recombinant cell of any one of embodiments 1, 3 to 9, or 11 to 21, or the method of any one of embodiments 2 to 8 or 10 to 24, wherein the microcystin is microcystin LA, microcystin LL, microcystin AR, microcystin YA, microcystin LM, microcystin VF, microcystin YM, microcystin LF, microcystin LR, [D-Asp$^3$]microcystin-LR, microcystin LW, microcystin FR, microcystin WR, microcystin LY, microcystin RR, or microcystin YR.

Embodiment 26: The method of any one of embodiments 22 to 24, wherein:
the recombinant cell is a recombinant *E. coli* cell;
the culturing comprises limiting or preventing exposure of the recombinant cells to D-erythro-β-methyl-iso-aspartic acid; the microcystin produced by the recombinant cell is at least 80%, at least 85%, at least 90%, at least 95%, at least 97.5%, or 100%, [D-Asp$^3$]microcystin-LR.

Definitions

As used in this application, the singular form "a", "an" and "the" include plural references unless the context clearly dictates otherwise. For example, the phrase "microcystin" also includes a plurality of microcystins.

As used herein, the term "comprising" means "including." Variations of the word "comprising", such as "comprise" and "comprises," have correspondingly varied meanings. Thus, for example, a composition "comprising" microcystins may consist only of microcystins or may include one or more additional components (e.g. other different cyanobacterial toxin/s).

As used herein, the term "subject" includes any animal of economic, social or research importance including bovine, equine, ovine, primate, avian and rodent species. Hence, a "subject" may be a mammal such as, for example, a human or a non-human mammal.

As used herein the terms "polynucleotide", "nucleotide sequence", and "nucleic acid sequence" refer to a single- or double-stranded polymer of deoxyribonucleotide bases, ribonucleotide bases, known analogues of natural deoxyribonucleotide bases and ribonucleotide bases, or mixtures thereof. The terms include reference to the specified sequence as well as to the sequence complimentary thereto, unless otherwise indicated.

As used herein, the terms "protein" and "polypeptide" each refer to a polymer made up of amino acids linked together by peptide bonds and are used interchangeably herein. For the purposes of the present invention a "polypeptide" may constitute a full length protein or a portion of a full length protein.

As used herein, a "microcystin polynucleotide" will be understood to encompass both a full length microcystin polynucleotide as well as fragments of a full length microcystin polynucleotide encoding microcystin polypeptide fragments that maintain capacity for the same biological activity characteristic of the full length microcystin polypeptide.

As used herein, a "microcystin polypeptide" will be understood to encompass both a full length microcystin polypeptide as well as fragments of a full length microcystin polypeptide that maintain capacity for the same biological activity characteristic of the full length microcystin polypeptide.

As used herein, a "recombinant host cell" or "host cell", refers to a cell into which exogenous (i.e. non-native/foreign) genetic material has been introduced. The exogenous genetic material is not identical to genetic material existing naturally within the host cell.

The terms will be understood to include progeny cells which inherit the exogenous genetic material. The recombinant host cell or host cell may be prokaryotic (e.g. bacterial cells including *Escherichia* sp. (e.g. *E. coli*) or eukaryotic (e.g. protist, fungal, plant and animal cells).

As used herein, the term "exogenous" in reference a biological entity and its relationship to a given cell (e.g. a host cell) will be understood to mean that the biological entity is not naturally produced by and is not a natural component of the host cell (i.e. it is not endogenous to the host cell, and is foreign to the host cell). For example, a polynucleotide, mcy polynucleotide, nucleotide sequence, gene, nucleotide, polypeptide, mcy polypeptide, peptide, protein, amino acid, substrate, or enzyme that is "exogenous" to a given cell (e.g. a host cell) will not be naturally produced by and will not naturally exist within the host cell.

Any description of prior art documents herein, or statements herein derived from or based on those documents, is not an admission that the documents or derived statements are part of the common general knowledge of the relevant art.

For the purposes of description all documents referred to herein and sequences referred to by GenBank accession number are hereby incorporated by reference in their entirety unless otherwise stated.

BRIEF DESCRIPTION OF THE FIGURES

Embodiments of the present invention will now be described, by way of an example only, with reference to the accompanying Figures wherein.

DETAILED DESCRIPTION

Figure 1:
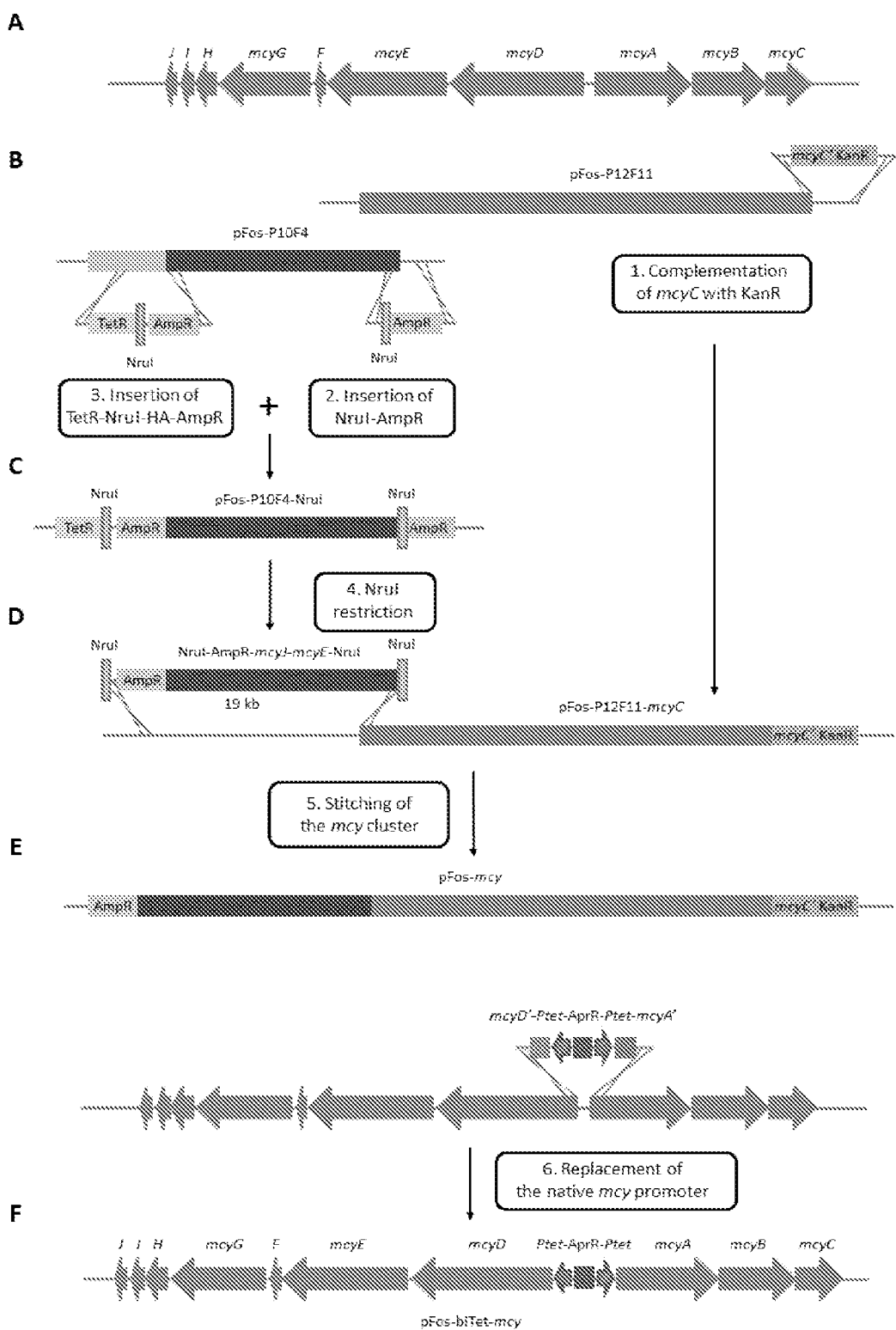
FIG. 1 is a diagram showing the reconstitution of the microcystin biosynthesis gene cluster with engineered promoter. (A) The structure of the microcystin biosynthesis gene cluster. (B) Two overlapping fosmids pFos-P10F4 and pFos-P12F11. (C) The mcyC gene was complemented on pFos-P12F11 by inserting the missing mcyC' segment and kanamycin resistance cassette using Red/ET recombineering. To linearize pFos-P10F4 in the following step, NruI restriction sites were inserted in pFos-P10F4 flanking mcyJ-mcyE via two rounds of Red/ET recombineering, with ampicillin and tetracycline resistant cassettes. (D) Engineered pFos-P10F4 was treated with NruI, and the resulting 19 kb NruI-AmpR-mcyJ-mcyE-NruI restriction fragment purified by gel extraction. (E) Linear-circular homologous recombineering leads to reconstitution of the entire microcystin cluster in one plasmid, pFos-mcy. (F) Replacement of the native mcy promoter with a bi-directional tetracycline inducible promoter fused to an apramycin resistant cassette.
Figure 2:
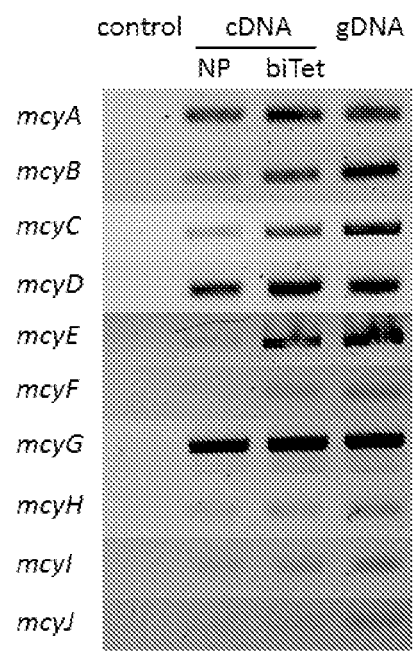
FIG. 2 is a photograph of an electrophoretogram used in a transcriptional analysis of mcy genes by classic PCR. Amplification used cDNA (40 ng) as template, reverse transcribed from mRNA extracted from *E. coli* GB05-MtaA-pFos-mcy (native promoter, NP) or GB05-MtaA-pFos-biTet-mcy (bi-directional tet promoter, biTet). *Microcystis aeruginosa* PCC 7806 genomic DNA was used as positive control, and the empty fosmid pFOS as a negative control.

Given the widespread prevalence of microcystins in drinking water supplies and the occurrences of microcystin contamination in seafood, there is a pressing need to develop more advanced detection methods and to better understand microcystin toxicology. The production of microcystins relies on slow-growing cyanobacterial cultures which is economically difficult and yields are inadequate. Furthermore, prevalent microcystin producers such as *M. aeruginosa* generate mixtures of microcystin isoforms and the separation of different microcystin isoforms is difficult. Existing microcystin purification techniques employ consecutive rounds of chromatography, and to isolate specific microcystin isoforms, different types of chromatography utilising several solvent changes are typically necessary in each round. Moreover, it can be difficult to obtain certain isoforms of microcystin as the correct cyanobacterial species needs to be obtained and grown in a manner that is effective for microcystin production at sufficient yield. Considered singularly or together, these factors make the production and isolation of microcystins by current methods considerably inadequate.

To the knowledge of the inventors, the present application is the first disclosure of a platform technology facilitating the recombinant production of microcystin in a host cell environment. The present invention provides remedies to one or several deficiencies noted in the prior art, including any one or more of increased microcystin yield, simplified isolation, capacity to direct production of certain microcystin isoforms and variants of these isoforms, strict control over the amount of microcystin production, and/or a means of obtaining microcystin at reduced cost and/or with increased efficiency compared to existing methodologies.

The present invention provides a system in which any microcystin isoform, any new isoform of microcystin, or variants of these isoforms, can be produced in a recombinant cell. The recombinant cell can be a bacterial cell, which may be of the genus *Escherichia*, for example, *Escherichia coli* (*E. coli*). The bacterial cell is transformed with heterologous genetic material encoding certain key elements for the production of the microcystin including, for example, one or more heterologous genes encoding a protein or protein component of a microcystin synthesis pathway and/or one or more genes encoding a heterologous promoter capable of initiating transcription of the heterologous microcystin pathway gene/s and/or one or more heterologous genes encoding a phosphopantethienyl transferase (PPT).

The prior art highlights that limited substrate availability for polyketide synthase (PKS) and non-ribosomal peptide synthetase (NRPS) products is a significant shortcoming of heterologous expression in certain bacteria such as *E. coli* (see, for example, Weissman, (2016), *Natural product reports* 33, 203-230), teaching away from embodiments of the present invention. Additionally, in arriving at the present invention the inventors were unexpectedly successful in overcoming a series of obstacles and impediments. It was recognised that bacterial hosts for heterologous protein production such as *E. coli* are problematic when the native PPT has limited specificity for modifying secondary metabolite synthetases (i.e. those of cyanobacteria made from PKS- and NRPS-containing biosynthetic pathways). Additionally, it was observed upon attempting to construct the recombinant system that the native host cell promoters were only capable of low level transcription with no detectable microcystin production observable. The lack of transcription factors to trigger microcystin gene expression (e.g. nitrogen-inducible transcription factors, transcription factors responsive to variations in light intensity and/or wavelength) in bacterial hosts used for heterologous microcystin production means that a key element needed to control the level of microcystin production is absent raising safety concerns. Despite this combination of impediments the present inventors were able to achieve the successful heterologous production of microcystin in bacterial host cells. Moreover, the system devised by the present inventors is significantly improved over existing methods of microcystin production and can be tailored to produce any of a wide variety of microcystin isoforms and variants in an efficient and controlled manner.

Recombinant Host Cells

The present invention provides recombinant host cells. The recombinant host cells are modified/manufactured and are not identical to any naturally-occurring entity. The host cells are transformed with one or more genetic elements necessary for the heterologous production of microcystin. The exogenous genetic material may integrate into the genome of the cell and/or remain in the host cell cytoplasm. The exogenous genetic material may be introduced into the host cell as a component of a vector such as a plasmid, cosmid, fosmid or similar.

In some embodiments, the exogenous genetic material is provided in multiple copies of a single vector (e.g. plasmid, cosmid, fosmid or similar). The vector may comprise one or more gene/s conferring resistance to one or multiple antibiotic type/s.

In some embodiments, the recombinant host cell is prokaryotic. For example, the recombinant host cell may be a bacterial cell. The bacterial cell may be Gram negative or Gram positive bacterial cell. The Gram negative bacterial cell may be selected from the group consisting of Aquificae, Bacteroidetes/Fibrobacteres-Chlorobi (FCB group), Deinococcus-Thermus, Fusobacteria, Gemmatimonadetes, Nitrospirae, Planctomycetes-Verrucomicrobia/Chlamydiae (PVC group), Proteobacteria, Spirochaetes and Synergistetes. The Gram positive bacterial cell may be selected from the group consisting of Actinobacteria, Firmicutes and Tenericutes.

In some embodiments, the recombinant host cell is a bacterium of the phylum Proteobacteria. Accordingly, the bacterium may be of the class Gammaproteobacteria.

Accordingly, the bacterium may be of the family Enterobacteriaceae. Accordingly, the bacterium may be of the genus *Escherichia*.

In certain embodiments, the recombinant host cell is a bacterium of the *Escherichia coli* species. Any strain of *E. coli* capable of heterologous production of microcystin can be used when performing the present invention. Without limitation, examples of *E. coli* strains that may be used include: BAP1, G1, B1157, 2155, L21, L21(AI), L21(DE3), L21(DE3) pLysS, LR, NN93, BNN97, BW25113, BW26434, CGSC Strain #7658, BW313, C600, C600 hflA150 (Y1073, BNN102), CSH50, D1210, DB3.1, DC10B, DH1, DH5α, DH5αpir, DH5αpir116 variant, NEB Turbo (NEB), DH10B (Invitrogen), DH12S (Invitrogen), DM1 (Invitrogen), E. Cloni® 5alpha (Lucigen), E. Cloni® 10G (Lucigen), E. Cloni® 10GF' (Lucigen), EPI300 (Epicentre), *E. coli* K12 ER2738 (NEB), ER2566 (NEB), ER2267 (NEB), H12R8a, HB101, HMS174(DE3), High-Control® BL21(DE3) (Lucigen), High-Control® 10G (Lucigen), IJ1126, IJ1127, IM01B, IM08B, IM30B, IM93B, JM83, JM101, JM103, JM105, JM106, JM107, JM108, JM109, JM109(DE3), JM110, JM2.300, JTK165, K12 3000, K12ΔH1Δtrp, LE392, M15 (Qiagen), M5219, Mach1, MC1061, MC11061(λ), MC1061Rif, MC4100, MFDpir, MG1655, MG1655 seqA-eYFP, MG1655 seqA-mEOS3.2, MG1655 seqA-PAmCherry, OmniMAX2, OverExpress® C41(DE3) (Lucigen), OverExpress® C41(DE3)pLysS (Lucigen), OverExpress® C43(DE3) (Lucigen), OverExpress® C43(DE3)pLysS (Lucigen), Rosetta™ (DE3)pLysS, Rosetta-gami(DE3)pLysS, RR1, RV308, S26, S26R1d, S26R1e, SG4121, SM10(λpir), SOLR (Stratagene), SS320 (Lucigen), STBL2 (Invitrogen), STBL4, SURE (Stratagene), SURE2 (Stratagene), TG1 (Lucigen), TOP10 (Invitrogen), Top10F' (Invitrogen), W3110, W3110 (λ857S7), WK6mut(λ), WM3064, XL1-Blue (Stratagene), XL1-Blue MRF' (Stratagene), XL2-Blue (Stratagene), XL2-Blue MRF' (Stratagene), XL1-Red (Stratagene), XL10-Gold (Stratagene), XL10-Gold KanR (Stratagene), *E. coli* GB05-MtaA, and each strain referred to in Table 2 below.

In certain embodiments, the recombinant host cell is not eukaryotic. In other embodiments the recombinant host cell is not a cyanobacterium or a recombinant cyanobacterium. In other embodiments the recombinant host cell is not a dinoflagellate or a recombinant dinoflagellate. In still other embodiments, the recombinant host cell (e.g. recombinant bacterium) does not comprise genetic material encoding additional cyanotoxin/s (for example, any one or more of cylindrospermopsin, anatoxin, homoanatoxin, saxitoxin, neosaxitoxin, lyngbyatoxin, aplysiatoxin, and/or nodularin). In some embodiments, the recombinant host cell (e.g. recombinant bacterium) comprises genetic material encoding additional cyanotoxin/s (for example, any one or more of cylindrospermopsin, anatoxin, homoanatoxin, saxitoxin, neosaxitoxin, lyngbyatoxin, aplysiatoxin, and/or nodularin).

The host cell may be transformed with one or more genetic elements necessary for the heterologous production of microcystin using any suitable method. Such methods are generally known in the art and are described in, for example,

*Molecular Cloning: A Laboratory Manual* (Joseph Sambrook, David W Russell, 3$^{rd}$. Edition, Cold Spring Harbour Press 2001), *Current Protocols in Molecular Biology* (Ausubel F. M. et al. (Eds), John Wiley and Sons, Inc 2007), *Molecular Cloning* (Maniatis et al., Cold Spring Harbor Laboratory, Cold Spring Harbor, N.Y., 1982) and *Current Protocols in Microbiology* (Coico et al (Eds), John Wiley and Sons, Inc, 2007), the entire contents of which are incorporated herein by cross-reference.

In some embodiments, the genetic material may be cloned into a vector construct. Suitable methods for the introduction of vector constructs and other foreign nucleic acid material into the host cell are generally known in the art, and described, for example, in *Current Protocols in Molecular Biology*, Ausubel et al. (Eds), New York: John Wiley & Sons, 2007) and *Molecular Cloning: A Laboratory Manual*, (Sambrook et al. 3rd Ed., Cold Spring Harbor Laboratory Press, Cold Spring Harbor, N.Y., 2001). By way of example, the host cells may be transformed by the "heat shock" method. Under this method the cells are chilled in the presence of divalent cations such as $Ca^{2+}$, which causes cell wall permeability. Cells are incubated on ice with the construct and briefly heat shocked (e.g. at 42° C. for 0.5-2 minutes) causing the vector construct to enter the cell. Alternatively, the host cells may be transformed with the vector construct by electroporation, a method involving briefly shocking the cells with an electric field causing the cells to briefly develop holes through which the construct may enter the cell. Natural membrane-repair mechanisms rapidly close these holes after the shock.

Following entry of the construct into the cell, the host cells may be cultured under conditions suitable to facilitate reproduction. Methods for the culture of are well known in the art and described in, for example, *Current Protocols in Microbiology*, (Coico, et al. (Eds), John Wiley & Sons, Inc., 2007). The culture may be performed in medium containing a substrate which facilitates the identification of transformed strains, for example, an antibiotic such as chloramphenicol, kanamycin or tetracycline.

Transformed recombinant host cells may be selected and propagated. For example, if the target vector contains one or more selectable markers, the transformed host cell may be identified by expression of the marker or markers.

Additionally or alternatively the genetic material may be inserted into the host cell genome by means of one or more transposons, or other mobile elements. These have been shown to mobilise large DNA fragments up to 59 kb in size. Mobilisation of transposons is mediated by transposases, usually resulting in the insertion of the DNA into target sequences in the genome. Putative transposases have been found to be associated with several biosynthetic gene clusters such as the microcystin and nodularin biosynthesis gene clusters. The ability of transposons to mobilise large gene clusters provides a DNA transfer system suitable for the transfer engineered biosynthetic gene clusters into null hosts for the expression of secondary metabolites.

The skilled addressee will recognise that other methods of introducing exogenous genetic material into the host cells are well known in the art and may also be used to perform the present invention.

Microcystin Genes

According to the present invention, host cells are transformed with exogenous genes encoding all or some protein component/s of a microcystin synthesis pathway.

Accordingly the host cells may be transformed with any one or more of the microcystin biosynthetic genes mcyA, mcyB, mcyC, mcyD, mcyE, mcyF, mcyG, mcyH, mcy, and/or mcyJ.

Additionally or alternatively, the host cells may be transformed with exogenous RNA (e.g. mRNA) generated by transcription of any one or more of the microcystin biosynthetic genes mcyA, mcyB, mcyC, mcyD, mcyE, mcyF, mcyG, mcyH, mcyI, and/or mcyJ.

The exogenous sequences may be codon-optimised for the host cell.

In some embodiments, the host cells are transformed with each of the microcystin biosynthetic genes mcyA, mcyB, mcyC, mcyD, mcyE, mcyF, mcyG, mcyH, mcyI, and mcyJ, and/or RNA transcripts of each gene.

In some embodiments, the host cells are transformed with each of the microcystin biosynthetic genes mcyA, mcyB, mcyC, mcyD, mcyE, mcyF, mcyG, mcyH, and mcyJ, and/or RNA transcripts of each gene.

In some embodiments, the host cells are transformed with each of the microcystin biosynthetic genes mcyA, mcyB, mcyC, mcyD, mcyE, mcyG, mcyH, mcyI, and mcyJ, and/or RNA transcripts of each gene.

In some embodiments, the host cells are transformed with each of the microcystin biosynthetic genes mcyA, mcyB, mcyC, mcyD, mcyE, mcyG, mcyH, and mcyJ, and/or RNA transcripts of each gene.

mcyA

The recombinant host cells may comprise an exogenous mcyA gene and/or RNA transcript/s thereof encoding a nonribosomal peptide synthetase (NRPS). The NRPS encoded by the mcyA gene may comprise any one or more of: two adenylation domains for the activation of serine and alanine, respectively; a condensation domain, a N-methyltransferase domain for N-methylation of dehydroserine; an epimerasation domain (e.g. at the C-terminus). Non-limiting examples of mcyA gene sequences that can be used to transform the host cells include the mcyA gene sequences shown in GenBank accession numbers JQ290083.1 (SEQ ID NO:79), JQ290093.1 (SEQ ID NO:80). AB019578.2 (SEQ ID NO:81), AF183408.1 (SEQ ID NO:71), AY212249.1 (SEQ ID NO:72), AJ441056.1 (SEQ ID NO:78) and KC699835.1 (SEQ ID NO:74). The mcyA gene sequences used to transform the host cells may have at least 60%, at least 70%, at least 75%, at least 80%, at least 85%, at least 90%, or at least 95% sequence identity to an mcyA gene sequence shown in GenBank accession number JQ290083.1 (SEQ ID NO:79), JQ290093.1 (SEQ ID NO:80), AB019578.2 (SEQ ID NO:81), AF183408.1 (SEQ ID NO:71), AY212249.1 (SEQ ID NO:72), AJ441056.1 (SEQ ID NO:78) or KC699835.1 (SEQ ID NO:74).

mcyB

Additionally or alternatively, the recombinant host cells may comprise an exogenous mcyB gene and/or RNA transcript/s thereof encoding a nonribosomal peptide synthetase (NRPS). The NRPS encoded by the mcyB gene may comprise two modules, each module comprising any one or more of: an adenylation domain; a condensation domain; a thiolation domain. Non-limiting examples of mcyB gene sequences that can be used to transform the host cells include the mcyB gene sequences shown in GenBank accession numbers JQ290092.1 (SEQ ID NO:82), AY034602.1 (SEQ ID NO:83), AB019578.2 (SEQ ID NO:81), AF183408.1 (SEQ ID NO:71), AY212249.1 (SEQ ID NO:72), AJ441056.1 (SEQ ID NO:78) and KC699835.1 (SEQ ID NO:74). The mcyB gene sequences used to transform the host cells may have at least 60%, at least 70%, at least 75%, at least 80%, at least 85%, at least 90%, or at least 95% sequence identity to an mcyB gene sequence shown in GenBank accession number JQ290092.1 (SEQ ID NO:82), AY034602.1 (SEQ ID NO:83), AB019578.2 (SEQ ID NO:81), AF183408.1 (SEQ ID NO:71), AY212249.1 (SEQ ID NO:72), AJ441056.1 (SEQ ID NO:78) or KC699835.1 (SEQ ID NO:74).

mcyC

Additionally or alternatively, the recombinant host cells may comprise an exogenous mcyC gene and/or RNA transcript/s thereof encoding a nonribosomal peptide synthetase (NRPS). The NRPS encoded by the mcyC gene may comprise a module comprising any one or more of: an adenylation domain; a condensation domain; a thiolation domain. Non-limiting examples of mcyC gene sequences that can be used to transform the host cells include the mcyC gene sequences shown in GenBank accession numbers JQ290091.1 (SEQ ID NO:84), AB019578.2 (SEQ ID NO:81), AF183408.1 (SEQ ID NO:71), AY212249.1 (SEQ ID NO:72), AJ441056.1 (SEQ ID NO:78) and KC699835.1 (SEQ ID NO:74). The mcyC gene sequences used to transform the host cells may have at least 60%, at least 70%, at least 75%, at least 80%, at least 85%, at least 90%, or at least 95% sequence identity to an mcyC gene sequence shown in GenBank accession number JQ290083.1 (SEQ ID NO:79), JQ290091.1 (SEQ ID NO:84), AB019578.2 (SEQ ID NO:81), AF183408.1 (SEQ ID NO:71), AY212249.1 (SEQ ID NO:72), AJ441056.1 (SEQ ID NO:78) or KC699835.1 (SEQ ID NO:74).

mcyD

Additionally or alternatively, the recombinant host cells may comprise an exogenous mcyD gene and/or RNA transcript/s thereof encoding a polyketide synthase (PKS). The PKS encoded by the mcyD gene may comprise two modules for type I PKSs. The first module may comprise any one or more of: a β-ketoacyl synthase (KS) domain; an acyl transferase (AT) domain; a dehydratase (DH) domain; a C-methyltransferase (CM) domain; a ketoreductase (KR) domain; and/or an acyl carrier protein (ACP) domain. The second module may comprise any one or more of: a β-ketoacyl synthase (KS) domain; acyl transferase (AT) domain; a dehydratase (DH) domain; a ketoreductase (KR) domain; an acyl carrier protein (ACP) domain. Non-limiting examples of mcyD gene sequences that can be used to transform the host cells include the mcyD gene sequences shown in GenBank accession numbers JQ290094.1 (SEQ ID NO:85), JQ290084.1 (SEQ ID NO:86), AF183408.1 (SEQ ID NO:71), AY212249.1 (SEQ ID NO:72), AJ441056.1 (SEQ ID NO:78), AB032549.2 (SEQ ID NO:73) and KC699835.1 (SEQ ID NO:74). The mcyD gene sequences used to transform the host cells may have at least 60%, at least 70%, at least 75%, at least 80%, at least 85%, at least 90%, or at least 95% sequence identity to an mcyD gene sequence shown in GenBank accession number JQ290094.1 (SEQ ID NO:85), JQ290084.1 (SEQ ID NO:86), AF183408.1 (SEQ ID NO:71), AY212249.1 (SEQ ID NO:72), AJ441056.1 (SEQ ID NO:78), AB032549.2 (SEQ ID NO:73) or KC699835.1 (SEQ ID NO:74).

mcyE

Additionally or alternatively, the recombinant host cells may comprise an exogenous mcyE gene and/or RNA transcript/s thereof encoding a mixed PKS-NRPS. The mixed PKS-NRPS encoded by the mcyE gene may comprise any one or more of: a β-ketoacyl synthase (KS) domain; an acyl transferase (AT) domain; a C-methyltransferase (CM) domain; an aminotransferase (AMT) domain; an NRPS module comprising two condensation domains, an adenylation domain, and a thiolation domain. Non-limiting examples of mcyE gene sequences that can be used to transform the host cells include the mcyE gene sequences shown in GenBank accession numbers JQ290095.1 (SEQ ID NO:87), JQ290085.1 (SEQ ID NO:88), AF183408.1 (SEQ ID NO:71), AY212249.1 (SEQ ID NO:72), AJ441056.1 (SEQ ID NO:78), AB032549.2 (SEQ ID NO:73) and KC699835.1 (SEQ ID NO:74). The mcyE gene sequences used to transform the host cells may have at least 60%, at least 70%, at least 75%, at least 80%, at least 85%, at least 90%, or at least 95% sequence identity to an mcyE gene sequence shown in GenBank accession number JQ290095.1 (SEQ ID NO:87), JQ290085.1 (SEQ ID NO:88), AF183408.1 (SEQ ID NO:71), AY212249.1 (SEQ ID NO:72), AJ441056.1 (SEQ ID NO:78), AB032549.2 (SEQ ID NO:73) or KC699835.1 (SEQ ID NO:74).

mcyF

Additionally or alternatively, the recombinant host cells may comprise an exogenous mcyF gene and/or RNA transcript/s thereof encoding a methyltransferase. Non-limiting examples of mcyF gene sequences that can be used to transform the host cells include the mcyF gene sequences shown in GenBank accession numbers JQ290096.1 (SEQ ID NO:69), JQ290086.1 (SEQ ID NO:70), AF183408.1 (SEQ ID NO:71), AY212249.1 (SEQ ID NO:72), AB032549.2 (SEQ ID NO:73) and KC699835.1 (SEQ ID NO:74). The mcyF gene sequences used to transform the host cells may have at least 60%, at least 70%, at least 75%, at least 80%, at least 85%, at least 90%, or at least 95% sequence identity to an mcyF gene sequence shown in GenBank accession number JQ290096.1 (SEQ ID NO:69), JQ290086.1 (SEQ ID NO:70), AF183408.1 (SEQ ID NO:71), AY212249.1 (SEQ ID NO:72), AB032549.2 (SEQ ID NO:73), or KC699835.1 (SEQ ID NO:74).

mcyG

Additionally or alternatively, the recombinant host cells may comprise an exogenous mcyG gene and/or RNA transcript/s thereof encoding a mixed PKS-NRPS. The mixed PKS-NRPS encoded by the mcyG gene may comprise any one or more of: a β-ketoacyl synthase (KS) domain, an acyl transferase (AT) domain, a C-methyltransferase (CM) domain, an ketoreductase (KR) domain, an acyl carrier protein (ACP) domain, an NRPS module comprising an adenylation domain and a thiolation (phosphopantetheine carrier) domain. Non-limiting examples of mcyG gene sequences that can be used to transform the host cells include the mcyG gene sequences shown in GenBank accession numbers JQ290097.1 (SEQ ID NO:89), JQ290087.1 (SEQ ID NO:90), AF183408.1 (SEQ ID NO:71), AY212249.1 (SEQ ID NO:72), AJ441056.1 (SEQ ID NO:78). AB032549.2 (SEQ ID NO:73) and KC699835.1 (SEQ ID NO:74). The mcyG gene sequences used to transform the host cells may have at least 60%, at least 70%, at least 75%, at least 80%, at least 85%, at least 90%, or at least 95% sequence identity to an mcyG gene sequence shown in GenBank accession number JQ290097.1 (SEQ ID NO:89), JQ290087.1 (SEQ ID NO:90), AF183408.1 (SEQ ID NO:71), AY212249.1 (SEQ ID NO:72), AJ441056.1 (SEQ ID NO:78), AB032549.2 (SEQ ID NO:73) or KC699835.1 (SEQ ID NO:74).

mcyH

Additionally or alternatively, the recombinant host cells may comprise an exogenous mcyH gene and/or RNA transcript/s thereof encoding ABC transporter component. The product encoded by the mcyH gene may comprise any one or more of: a membrane-spanning and an ATP-binding domain of the ABC transporter. Non-limiting examples of mcyH gene sequences that can be used to transform the host cells include the mcyH gene sequences shown in GenBank accession numbers JQ290098.1 (SEQ ID NO:91), JQ290088.1 (SEQ ID NO:92), AF183408.1 (SEQ ID NO:71), AY212249.1 (SEQ ID NO:72), AJ441056.1 (SEQ ID NO:78), AB032549.2 (SEQ ID NO:73) and KC699835.1 (SEQ ID NO:74). The mcyH gene sequences used to transform the host cells may have at least 60%, at least 70%, at least 75%, at least 80%, at least 85%, at least 90%, or at least 95% sequence identity to an mcyH gene sequence shown in GenBank accession number JQ290098.1 (SEQ ID NO:91), JQ290088.1 (SEQ ID NO:92), AF183408.1 (SEQ ID NO:71), AY212249.1 (SEQ ID NO:72), AJ441056.1 (SEQ ID NO:78), AB032549.2 (SEQ ID NO:73) or KC699835.1 (SEQ ID NO:74).

mcyI

Additionally or alternatively, the recombinant host cells may comprise an exogenous mcyI gene and/or RNA transcript/s thereof encoding a methyltransferase. Non-limiting examples of mcyI gene sequences that can be used to transform the host cells include the mcy gene sequences shown in GenBank accession numbers JQ290099.1 (SEQ ID NO:75), JQ290089.1 (SEQ ID NO:76), AF183408.1 (SEQ ID NO:71), AY212249.1 (SEQ ID NO:72), AB032549.2 (SEQ ID NO:73) and KC699835.1 (SEQ ID NO:74). The mcy gene sequences used to transform the host cells may have at least 60%, at least 70%, at least 75%, at least 80%, at least 85%, at least 90%, or at least 95% sequence identity to an mcyI gene sequence shown in GenBank accession number JQ290099.1 (SEQ ID NO:75), JQ290089.1 (SEQ ID NO:76), AF183408.1 (SEQ ID NO:71), AY212249.1 (SEQ ID NO:72), AB032549.2 (SEQ ID NO:73) or KC699835.1 (SEQ ID NO:74).

mcyJ

Additionally or alternatively, the recombinant host cells may comprise an exogenous mcyJ gene and/or RNA transcript/s thereof encoding a methyltransferase. Non-limiting examples of mcyJ gene sequences that can be used to transform the host cells include the mcyJ gene sequences shown in GenBank accession numbers JQ290100.1 (SEQ ID NO:93), JQ290090.1 (SEQ ID NO:94), AB254436.1 (SEQ ID NO:95), AF183408.1 (SEQ ID NO:71), AY212249.1 (SEQ ID NO:74), AJ441056.1 (SEQ ID NO:78), AB032549.2 (SEQ ID NO:73) and KC699835.1 (SEQ ID NO:74). The mcyJ gene sequences used to transform the host cells may have at least 60%, at least 70%, at least 75%, at least 80%, at least 85%, at least 90%, or at least 95% sequence identity to an mcyJ gene sequence shown in GenBank accession number JQ290100.1 (SEQ ID NO:93), JQ290090.1 (SEQ ID NO:94), AB254436.1 (SEQ ID NO:95), AF183408.1 (SEQ ID NO:71), AY212249.1 (SEQ ID NO:72), AJ441056.1 (SEQ ID NO:78), AB032549.2 (SEQ ID NO:73) or KC699835.1 (SEQ ID NO:74).

mcyT

Additionally or alternatively, the recombinant host cells may comprise an exogenous mcyT gene and/or RNA transcript/s thereof encoding a thioesterase. Non-limiting examples of mcyT gene sequences that can be used to transform the host cells include the mcyT gene sequences shown in GenBank accession number EU266362.1 (SEQ ID NO:77) or AJ441056.1 (SEQ ID NO:78). The mcyT gene sequences used to transform the host cells may have at least 60%, at least 70%, at least 75%, at least 80%, at least 85%, at least 90%, or at least 95% sequence identity to an mcyT gene sequence shown in GenBank accession number EU266362.1 (SEQ ID NO:77) or AJ441056.1 (SEQ ID NO:78).

mcyL

Additionally or alternatively, the recombinant host cells may comprise an exogenous mcyL gene and/or RNA transcript/s thereof encoding an acetyl-coenzyme A-dependent O-acetyltransferase. A non-limiting example of an mcyL gene sequence that can be used to transform the host cells includes the mcyL gene sequence shown in GenBank accession number KC699835.1 (SEQ ID NO:74). The mcyL gene sequence used to transform the host cells may have at least 60%, at least 70%, at least 75%, at least 80%, at least 85%, at least 90%, or at least 95% sequence identity to an mcyL gene sequence shown in GenBank accession number KC699835.1 (SEQ ID NO:74).

Non-limiting and exemplary examples of complete microcystin biosynthetic pathway gene sequences that can be used to transform the host cells include GenBank accession no. AF183408.1 (SEQ ID NO:71) (*Microcystis aeruginosa* PCC 7806), GenBank accession no. AJ441056 (SEQ ID NO:78) (*Planktothrix agardhii*) and GenBank accession no. AJ536156 (SEQ ID NO:96) (*Anabaena* sp. 90). Complete microcystin biosynthetic pathway gene sequences that can be used to transform the host cells may have at least 60%, at least 70%, at least 75%, at least 80%, at least 85%, at least 90%, or at least 95% sequence identity to the polynucleotide sequences shown in GenBank accession no. AF183408.1 (SEQ ID NO:71) (*Microcystis aeruginosa* PCC 7806), GenBank accession no. AJ441056 (SEQ ID NO:78) (*Planktothrix agardhii*) or GenBank accession no. AJ536156 (SEQ ID NO:96) (*Anabaena* sp. 90).

Sequence Identity

The recombinant hosts cells may be transformed with polynucleotide sequences (DNA and/or RNA) having a specified degree of sequence identity with a given microcystin biosynthetic gene (e.g. mcyA, mcyB, mcyC, mcyD, mcyE, mcyF, mcyG, mcyH, mcy, mcyJ, or mcyT).

The percentage of sequence identity between two sequences may be determined by comparing two optimally aligned sequences over a comparison window. A portion of a sequence in the comparison window may, for example, comprise deletions or additions (i.e. gaps) in comparison to a reference sequence (e.g. one derived from another species) which does not comprise deletions or additions, in order to align the two sequences optimally, or vice versa. A percentage of sequence identity may then be calculated by determining the number of positions at which identical nucleotides occur in both sequences to yield the number of matched positions, dividing the number of matched positions by the total number of positions in the window of comparison and multiplying the result by 100 to yield the percentage of sequence identity.

In the context of two or more nucleic acid sequences, the percentage of sequence identity refers to the specified percentage of nucleotides that are the same over a specified region (or, when not specified, over the entire sequence) when compared and aligned for maximum correspondence over a comparison window, or designated region as measured using one of the following sequence comparison algorithms or by manual alignment and visual inspection.

For sequence comparison, typically one sequence acts as a reference sequence to which test sequences are compared. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percentage of sequence identity for the test sequence(s) relative to the reference sequence, based on the program parameters.

Methods of alignment of sequences for comparison are known in the art. Optimal alignment of sequences for determination of sequence identity can be achieved conventionally using known computer programs, including, but not limited to: CLUSTAL in the PC/Gene program (available from Intelligenetics, Mountain View, Calif.); the ALIGN program (Version 2.0) and GAP, BESTFIT, BLAST, FASTA, and TFASTA in the GCG Wisconsin Genetics Software Package, Version 10 (available from Accelrys Inc., 9685 Scranton Road. San Diego, Calif., USA). Alignments using these programs can be performed using the default parameters. Another method for determining the best overall match between a query sequence and a subject sequence, also referred to as a global sequence alignment, can be determined using the FASTDB computer program based on the algorithm of Brutlag and colleagues (Comp. App. Biosci. 6:237-245 (1990)).

Microcystin Gene Organisation and Transcription

The microcystin biosynthetic genes and/or RNA transcripts thereof used to transform the host cell may be organised in any manner appropriate to facilitate their expression. For example, individual genes may be organised into one or more operons (e.g. 1, 2, 3, 4 or 5 operons).

By way of non-limiting example the genes may be organised into a single operon. The single operon may comprise mcyA, mcyB, mcyC, mcyD, mcyE, optionally mcyF, mcyG, mcyH, optionally mcyI, mcyJ, and optionally mcyT (in that order or in a different order).

By way of non-limiting example, the genes may be organised into first and second operons. The first operon may comprise mcyA, mcyB, mcyC (in that order or in a different order), the second operon may comprise mcyD, mcyE, mcyF, mcyG, mcyH, mcy, and mcyJ (in that order or in a different order).

By way of non-limiting example, the genes may be organised into first, second and third operons. The first operon may comprise mcyA, mcyB, mcyC (in that order or in a different order), the second operon may comprise mcyG, mcyD, mcyJ, mcyE, mcyF, mcyI (in that order or in a different order), and the third operon may comprise mcyH.

By way of non-limiting example, the genes may be organised into a single operon. The single operon may comprise mcyA, mcyB, mcyC, mcyD, mcyE, mcyG, mcyH, mcyJ, and mcyT (in that order or in a different order).

The exogenous genetic material (DNA) may integrate into the genome of the host cell. Additionally or alternatively, the exogenous genetic material (DNA and/or RNA) may remain in the host cell cytoplasm. For either purpose, the exogenous genetic material may be introduced into the host cell as a component of a vector such as a plasmid, cosmid, fosmid or similar.

For example the exogenous genetic material may be cloned into a vector. The vector may comprise, for example, a DNA, RNA or complementary DNA (cDNA) sequence. The vector may be a plasmid vector, a viral vector, or any other suitable vehicle adapted for the insertion of foreign sequences, their introduction into the host cells and the expression of the introduced sequences. The vector may be an expression vector and may include expression control and processing sequences such as a promoter, an enhancer, ribosome binding sites, polyadenylation signals and transcription termination sequences. The expression control and processing sequences may be optimised for use in the host cells. For example, if the host cells are E. coli, then E. coli regulatory elements (e.g. promoters, terminators, ribosome binding sequences) may be included. The invention also contemplates host cells transformed by such vectors. For example, the polynucleotides of the invention may be cloned into a vector which is transformed into a bacterial host cell, for example E. coli. Methods for the construction of vectors and their transformation into host cells are generally known in the art, and described in standard texts such as, for example, Sambrook et al. (1989) Molecular Cloning: A Laboratory Manual, 2nd ed., Cold Spring Harbor Laboratory Press, Plainview, N.Y.; and Ausubel et al. (Eds) Current Protocols in Molecular Biology (2007), John Wiley and Sons, Inc.

In some embodiments, the recombinant host cell may comprise an exogenous promoter sequence and/or transcription factor/s suitable for expression of the exogenous microcystin polynucleotides and be operably associated with them.

In some embodiments, the host cell may be transformed an exogenous promoter sequence operably connected to the mcy gene sequence/s and not provided with an exogenous transcription factor. In such embodiments, endogenous transcription factor/s of the host cell may use the exogenous promoter for transcription of the mcy gene/s.

In some embodiments, the host cell is transformed an exogenous promoter sequence operably connected to the mcy gene sequence/s and is provided with exogenous transcription factor/s capable of initiating transcription of the mcy gene/s via the exogenous promoter.

Without any limitation, the promoter may be an inducible promoter allowing control of gene expression within the recombinant host cell.

Additionally or alternatively, the promoter may be a ubiquitous or cell-specific promoter.

Additionally or alternatively, the promoter may be a eukaryotic promoter, a prokaryotic promoter, a bacterial promoter, a constitutive promoter, a unidirectional promoter, a bidirectional promoter, and/or a processive promoter capable of facilitating production of mRNA transcripts of at least 5 kb, at least 10 kb, at least 15 kb, at least 20 k, at least 25 kb, at least 30 kb, or at least 35 kb in length.

In some embodiments, the promoter is capable supporting/initiating activity of transcription factors capable of transcribing long templates (e.g. more than 5 kb, 10 kb, 15 kb, 20 kb, 25 kb, 30 kb or more than 35 kb).

In some embodiments, the promoter is capable supporting/initiating activity of transcription factors capable of transcribing long templates (e.g. more than 5 kb, 10 kb, 15 kb, 20 kb, 25 kb, 30 kb or more than 35 kb) at low copy number.

Non-limiting examples of suitable promoters include antibiotic-inducible (e.g. tetracycline-inducible) promoters, alcohol-inducible promoters, steroid-inducible promoters, metal-inducible promoters, light-inducible promoters, and temperature-inducible promoters.

In certain embodiments, the recombinant host cells may comprise microcystin gene sequence/s operably associated with tetracycline-inducible ('tet-') promoter/s (e.g. Ptet, $Ptet_O$). The promoter/s may be bi-directional. The promoter/s may be located between divergent operons each comprising one or more mcy genes. By way of non-limiting example, the promoter/s may be located between and operably linked to a first operon comprising mcyC, mcyB, mcyA, and a second operon mcyD, mcyE, mcyF, mcyG, mcyH, mcyI, mcyJ, the first and second operons being divergent from one another (i.e. transcribed in opposing directions).

Phosphopantethienyl Transferases (PPT)

The mcy gene products produced in the recombinant host cell may require and/or benefit from post-translational modification which is an important consideration for expression of PKS- and NRPS-containing biosynthetic pathways.

A phosphopantethienyl transferase (PPT) present within the recombinant host cell may activate these multimodular enzymes, for example, by the addition of a phosphopantethienyl linker to their carrier proteins to facilitate substrate attachment.

In some embodiments, the recombinant host cell comprising the microcystin genes and/or RNA transcripts thereof is not provided with an exogenous PPT and/or is not transformed with a nucleic acid sequence encoding an exogenous PPT. In such embodiments, a native/endogenous PPT of the host cell may be capable of carrying out the post-translational modifications to provide a microcystin isoform or variant thereof.

In other embodiments, the recombinant host cell comprising the microcystin genes and/or RNA transcripts thereof is provided with an exogenous PPT and/or is transformed with a nucleic acid sequence encoding an exogenous PPT. The nucleic acid sequence encoding the exogenous PPT may be stably integrated into the genome of the host cell, or remain in the cytoplasm of the host cell (e.g. in a vector).

The PPT (exogenous or endogenous to the recombinant host cell) is preferably capable of activating PKS and/or NRPS. The PPT may be "promiscuous" in the sense of having broad substrate specificity. The PPT may be a bacterial PPT of bacteria that are capable of intrinsically producing PKS and/or NRPS enzymes (e.g. cyanobacteria, *Bacillus* sp. (e.g. *Bacillus subtilis*), myxobacteria, actinobacteria (e.g. *Streptomyces* sp.), *Pseudomonas* sp.).

In some embodiments the exogenous PPT is a cyanobacterial PPT, such as a PPT from *Nodularia spumigena*. The PPT may be, for example, a *Nodularia spumigena* NSOR10 PPT.

Substrates

Over 100 isoforms of microcystin have been isolated from different species of cyanobacteria, varying by degree of methylation, hydroxylation, epimerization, peptide sequence and/or toxicity. The present invention provides a system in which any microcystin isoform, any new isoform of microcystin, or variants of these isoforms, can be produced in a recombinant host cell. Without any particular limitation, the recombinant host cell may be a bacterial cell, and the bacterial cell may be of the genus *Escherichia* (e.g. *E. coli*).

Referring to Example One of the present specification and by way of non-limiting example only, *M. aeruginosa* primarily produces two microcystin isoforms, microcystin-LR and [D-Asp$^3$]microcystin-LR which lacks a methyl group on aspartic acid at position 3. The recombinant host cell used to express microcystin in this case was *E. coli* in which there is in an absence of an essential precursor (β-methyl-aspartic acid) meaning that microcystin-LR was not produced. Unexpectedly, it was observed that the *E. coli* host incorporated native/endogenous aspartic acid in place of β-methyl-aspartic acid resulting in the production of [D-Asp$^3$]microcystin-LR, a key product used in toxicology studies. In doing so, the recombinant *E. coli* host unexpectedly addressed another problem of the prior art in providing a pure source of this microcystin isoform without requiring purification from a mixture of isoforms.

The system devised by the present inventors demonstrates a means to promote or repress the production of certain target microcystin isoforms in recombinant host cells by controlling the availability of specific substrate/s used in the biosynthesis of the microcystin isoform/s. This may be achieved, for example, by selecting a recombinant host cell that does not endogenously produce one or more substrate/s required for microcystin production. Additionally or alternatively, this may be achieved by introducing exogenous substrate/s required for microcystin production into the recombinant host cell, for example, by expression of polynucleotides encoding the substrates or by providing a supply of the substrate to the host cell.

In some embodiments, the recombinant host cell may lack or may be provided with an amino acid and/or a hydroxy acid (e.g. an alpha hydroxy acid or a beta hydroxy acid). Non-limiting examples of suitable amino acids include L- or D-configurations of any known amino acid such as, for example, arginine, tyrosine, leucine, alanine, tryptophan, phenylalanine, glutamine, methionine, valine, aspartic acid, D-erythro-β-methyl-iso-aspartic acid, tetrahydrotyrosine, homoisoleucine, homophenylalanine, homotyrosine, homoarginine, 2-aminoisobutyric acid. 3-amino-9-methoxy-2,6,8-trimethyl-10-phenyldeca-4,6-dienoic acid (Adda) variants, including 9-O-acetyl-Adda, agmatine, beta-alanine, asparagine, cysteine, glutamic acid, glycine, histidine, l-histidine, leucine, isoleucine, lysine, phenyl beta-alanine, proline, serine, threonine, citrulline, creatine, norvaline, ornithine, phenylalanine, and any combination thereof.

Non-limiting examples of suitable alpha-hydroxy acids and beta-hydroxy acids include alpha-hydroxy-butyric acid, alpha-hydroxyisobutyric acid, alpha-hydroxy-alpha-ethyl-butyric acid, alpha-hydroxyisocaproic acid, alpha-hydroxyisolaveric acid, atrolactic acid, alpha-hydroxy-beta-methyl-valeric acid, beta-hydroxybutyric acid, beta-phenyl lactic acid, beta-phenyl lactic acid, beta-phenylpyruvic acid, alpha-hydroxystearic acid, alpha-hydroxycaproic acid, alpha-hydroxybutyric acid, citric acid ethyl pyruvate, alpha-hydroxyvaleric acid, galacturonic acid, beta-butyrolactone, glucoheptonic acid, glucoheptono 1,4 lactone, gluconic acid, gluconolactone glucuronic acid, glucuronolactone, glycolic acid, isopropyl pyruvate, lactic acid, alpha-hydroxymyristic acid, mailic acid, alpha-hydroxyoctanoic acid, beta-propiolactide, amndelic acid, pivalolactone, emthyl pyruvate, mucic acid, alpha-hydroxyisovaleric acid, pivalolactone, pyruvic acid, saccharic acid, alpha-hydroxyacetic acid, saccharic acid 1,4-lactone, alpha-hydroxyheptanoic acid, alpha-hydroxydecanoic acid, tartaric acid, gamma-butyrolactone, tetramethylglycolide, tartronic acid, and any combination thereof.

In some embodiments, the host cell may lack or may be provided with synthetic variants of the 2-aminoisobutyric acid and/or 3-amino-9-methoxy-2,6,8-trimethyl-10-phenyl-4,6-decadienoic acid (Adda) compounds.

Without being limited to theory, substrates provided to the recombinant host cell may be incorporated to provide different microcystin isoforms and variants in the following manner. The adenylation domain (A-domain) of the NRPS recognizes and activates amino acid substrate to an aminoacyl adenylate in an ATP and Mg$^{2+}$-dependent reaction, which is then tethered the 4'-phosphopantetheine moiety of the peptidyl carrier protein (PCP) forming a thioester. The substrate specificity of the A-domain is largely dictated by a 10-residue 'specificity conferring code'. Some A-domains, such as those within the microcystin synthetase, exhibit relaxed substrate specificity and are capable of activating more than one amino acid substrate. Following activation by the A-domain, the aminoacyl adenylate intermediate is transferred to the next module via the PCP, where the condensation domain forms a peptide bond between the growing peptide chain on the upstream PCP-domain and the activated amino acid tethered to the downstream PCP-domain. Peptide bond formation occurs via nucleophilic attack of the donor acyl group by the amino group of the acceptor aminoacyl adenylate.

In some embodiments, exogenous substrate may be incorporated into the microcystin at the either or both of two main variable positions (i.e. at positions 2 and 4). Additionally or alternatively, the exogenous substrate may be incorporated into the microcystin at any one or more of the other five available amino acid positions of the cyclic peptide structure.

Potentially any different isoform or variant thereof may be produced by the recombinant host cells of the present invention including, for example, isoforms LA, LL, AR, YA, LM, VF, YM, LF, LR, [D-Asp$^3$]microcystin-LR, LW, FR, WR, LY, RR, and YR.

Suitable culture reagents and conditions for the recombinant host cells are well known in the art. The specific reagents and conditions used will depend on the recombinant host cells being used to produce the microcystin or components thereof. Following culturing the host cells may be isolated or concentrated (e.g. by filtration and/or centrifugation) and lysed to allow collection of the microcystin or components thereof. The microcystin or components thereof may be purified and/or separated from other compounds in the lysate using known means.

It will be appreciated by persons of ordinary skill in the art that numerous variations and/or modifications can be made to the present invention as disclosed in the specific embodiments without departing from the spirit or scope of the present invention as broadly described. The present embodiments are, therefore, to be considered in all respects as illustrative and not restrictive.

EXAMPLE(S)

The present invention will now be described with reference to specific Example(s), which should not be construed as in any way limiting.

Example One 1.1 Introduction

The detection and toxicological study of microcystins is hampered by the limited availability and high cost of toxin standards. In these experiments a system of heterologous expression of recombinant microcystin synthetases in *Escherichia coli* was developed to produce the microcystin isoforms microcystin-LR and microcystin [D-Asp$^3$]microcystin-LR. The 55 kb microcystin gene cluster from *Microcystis aeruginosa* sp. PCC 7806 was assembled using Red/ET recombineering, and native promoters were replaced with inducible Ptet$_O$ promoters to yield production levels superior to *M. aeruginosa*. The expression platform described herein can be tailored to heterologously produce a wide variety of microcystin variants, and potentially other cyanobacterial natural products of commercial relevance.

1.2 Materials and Methods

Bacterial Strains and Culture Conditions

*Microcystis aeruginosa* PCC 7806 was cultured in BG11 medium with constant illumination at 25 μmol photons·m$^{-2}$·s$^{-1}$. *E. coli* strains (Table 1), were cultured at 37° C., with shaking (200 rpm) in lysogeny broth (LB) supplemented with appropriate antibiotic/s for plasmid selection. The heterologous expression strain *E. coli* GB05-MtaA13, engineered with a chromosomally-integrated promiscuous PPTase (MtaA), was used for fosmid expression and cultured in LB, Terrific Broth (TB) or M9 minimal medium supplemented with 15 μg·mL$^{-1}$ chloramphenicol.

TABLE 1

| Strains and Plasmids | Genotype or features |
|---|---|
| *E. coli* strains | |
| GB2005 | Derivative of HS996. Endogenous recET locus and a putative Redα-like exonuclease DLP12 prophage ybcC were deleted. Used for classical cloning. (SEQ |
| GB05-red[5] | recA and lambda red operon were inserted at ybcC locus under control of the BAD promoter (pBAD). Used for linear-circular homologous recombineering (LCHR). |
| GB05-MtaA | The promiscuous PPTase MtaA from myxobacterium *Stigmatella aurantiaca* DW4/3-1 was integrated into the genome. Used for fosmid expression. |
| EPI300[6] | Contains a mutant trfA gene under the control of pBAD, for induction of pCC1FOS to high copy number via oriV activation. Used for plasmid propagation. |
| Plasmids | |
| pFos-P12F11 | pCC1FOS (Epicentre) containing partial microcystin biosynthetic gene cluster (partial mcyC, mcyB, mcyA, mcyD, and 5' region of mcyE). |
| pFos-P10F4 | pCC1FOS (Epicentre) containing partial microcystin biosynthetic gene cluster (mcyJ, mcyI, mcyH, mcyG, mcyF, and 3' region of mcyE). |
| pET15b::mcyC'-KanR | pET15b with 3' region of mcyC gene inserted between BamHI and NdeI restriction sites, and kanamycin resistance cassette inserted between NcoI and XbaI sites. |
| pET28b::TetR-NruI-Amp R | pET28b with tetracycline resistance cassette inserted between EcoRI and NotI, and sequence containing (NruI digest sites, sequence homologous to pFos-P12F11 fosmid backbone, and ampicillin resistance cassette) were inserted between NotI and XhoI. |
| pFos-P12F11-mcyC | pCC1FOS (Epicentre) containing partial microcystin biosynthetic gene cluster (mcyC, mcyB, mcyA, mcyD, and partial mcyE). |
| pFos-mcy | pCC1FOS (Epicentre) containing the complete microcystin gene cluster under control of native mcy promoter. |
| pET28b::mcyD'-Ptet-ApraR-Ptet-mcyA' | pET28b with bi-directional Ptet$_O$ promoter flanked with partial mcyD and mcyA genes as homologous arm for LCHR, and an apramycin resistance cassette between the two promoters as selection marker |
| pFos-biTet-mcy | pCC1FOS (Epicentre) containing the complete microcystin gene cluster under control of bi-directional Ptet$_O$ promoter. |

List of strains and plasmids used in this study

RNA Isolation, PCR and Real Time qPCR

Total RNA was isolated using Direct-zol RNA miniprep kit (Zymo Research), performing *E. coli* lysis with Trizol (Invitrogen, USA), as per manufacturer's instructions. Following PCR confirmation of the absence of DNA in the RNA samples using primers targeting the 16S rRNA gene, 200 ng of total RNA was used for cDNA synthesis by SuperScript II cDNA synthesis kit (New England Biolabs).

PCR was performed using BIOTaq DNA polymerase (Bioline, Australia) with primers listed in Table 2. The qPCR was performed in triplicates in 7500 fast real-time PCR system (Applied Biosystems, USA) with primers listed in Table 3, and the expression level of mcy genes were normalized to 16s rRNA levels of respective samples.

TABLE 2

| Gene targeted | Distance from promoter (kb) | Nucleotide Sequences of primers |
|---|---|---|
| mcyC | 15.8 | Fwd: CACCTGTCTTGATGCTTATG (SEQ ID NO: 1)<br>Rev: CTATTGCCTCGGAATTATCTC (SEQ ID NO: 2) |
| mcyB | 11.0 | Fwd: CTGAGGGGATTACGGATTGA (SEQ ID NO: 3)<br>Rev: ACCATATAAGCGGGCAGTTG (SEQ ID NO: 4) |
| mcyA | 0 | Fwd: TGATAGAGAAGAGGCACGATATGGAAGCACATCTGG TTTC (SEQ ID NO: 5)<br>Rev: GCGTCCGGCGTAGAGGATCGGATATCTGTAGAGATG ACCTCAAG (SEQ ID NO: 6) |
| mcyD | 0 | Fwd: GATAGAGAAGAGGATCGACATGGACTTTCAAGATAA AAAGAAC (SEQ ID NO: 7)<br>Rev: ATGATGATGATGGCTGCTGCGATATCCTGCTGGTTCC AGCG (SEQ ID NO: 8) |
| mcyE | 16.0 | Fwd: TGTGCCAGATGAACCC (SEQ ID NO: 9)<br>Rev: GAGCAATGCGAACAGC (SEQ ID NO: 10) |
| mcyF | 22.6 | Fwd: CCAAGTCAATCTGGAACATCTCAA (SEQ ID NO: 11)<br>Rev: ATAATGAGCCGTACAACAGCCAAT (SEQ ID NO: 12) |
| mcyG | 24.9 | Fwd: CGGCAGCCATATGGAACAGGGATTATTTAGCAG (SEQ ID NO: 13)<br>Rev: GTGGTGGTGCTCGAGTTAATGGCGACGGCTCCGATT (SEQ ID NO: 14) |
| mcyH | 32.4 | Fwd: CAAACACCGGATTATGAAAAGGTA (SEQ ID NO: 15)<br>Rev: AACCTTCGCCTGGTTCGAT (SEQ ID NO: 16) |
| mcyI | 33.7 | Fwd: TGGCTGAATCGGACTTTGTTT (SEQ ID NO: 17)<br>Rev: AACATTTCCCGCGTTTCACT (SEQ ID NO: 18) |
| mcyJ | 34.7 | Fwd: TGCGGAAGCTTTTCGAGTTTT (SEQ ID NO: 19)<br>Rev: TCTAGGCAAACAATCCGCTACA (SEQ ID NO: 20) |

List of primers used in this study for cDNA amplification. Primers used for the transcriptional analysis, the distance between the target and the promoter (between mcyA and mcyD) is indicated.

TABLE 3

| Gene targeted | Distance from promoter (kb) | Nucleotide Sequences of primers | Amplicon size (bp) |
|---|---|---|---|
| mcyC | 16.9 | Fwd: TTGTTTCACTTGTGTTCCCTCAA (SEQ ID NO: 21)<br>Rev: GGCTTCTCCCCCGACAATTA (SEQ ID NO: 22) | 100 |
| mcyB | 11.0 | Fwd: CTGAGGGGATTACGGATTGA (SEQ ID NO: 23)<br>Rev: ACCATATAAGCGGGCAGTTG (SEQ ID NO: 24) | 200 |
| mcyA | 7.6 | Fwd: GCGACGGCCAATGATGTC (SEQ ID NO: 25)<br>Rev: GAGGGCGCGGGTTTG (SEQ ID NO: 26) | 54 |
| mcyD | 9.1 | Fwd: AGTTAGCAACGGGAGACATGATC (SEQ ID NO: 27)<br>Rev: TAAAACCGGTAGCTGGAAATACAAT (SEQ ID NO: 28) | 111 |
| mcyE | 17.3 | Fwd: ATACCGTTGACGGCGGTTT (SEQ ID NO: 29)<br>Rev: AGGGCTAAAGGATGACGACAAA (SEQ ID NO: 30) | 100 |
| mcyF | 22.6 | Fwd: CCAAGTCAATCTGGAACATCTCAA (SEQ ID NO: 31) | 70 |

TABLE 3-continued

| Gene targeted | Distance from promoter (kb) | Nucleotide Sequences of primers | Amplicon size (bp) |
|---|---|---|---|
| | | Rev: ATAATGAGCCGTACAACAGCCAAT (SEQ ID NO: 32) | |
| mcyG | 27.2 | Fwd: CAGCCGCTATTTTAGGCCATA (SEQ ID NO: 33) Rev: CCTCGATGGCTGACCAGTTT (SEQ ID NO: 34) | 100 |
| mcyH | 32.4 | Fwd: CAAACACCGGATTATGAAAAGGTA (SEQ ID NO: 35) Rev: AACCTTCGCCTGGTTCGAT (SEQ ID NO: 36) | 67 |
| mcyI | 33.7 | Fwd: TGGCTGAATCGGACTTTGTTT (SEQ ID NO: 37) Rev: AACATTTCCCGCGTTTCACT (SEQ ID NO: 38) | 61 |
| mcyJ | 34.7 | Fwd: TGCGGAAGCTTTTCGAGTTTT (SEQ ID NO: 39) Rev: TCTAGGCAAACAATCCGCTACA (SEQ ID NO: 40) | 64 |

List of primers used in this study for qPCR. Primers used for the quantitative transcriptional analysis (RT-qPCR), the distance between the target and the promoter (between mcyA and mcyD) is indicated.

Preparation of the *M. aeruginosa* PCC 7806 Genomic Fosmid Library

High molecular weight genomic DNA was extracted from a 1 L stationary phase culture of *M. aeruginosa* PCC 7806 as previously described (Morin et al. (2010), Journal of Microbiological Methods 80, 148-154). The genomic library was prepared using the Copy Control Fosmid Library Production kit (Epicentre, USA), with minor modifications. Briefly, the size selection by agarose gel electrophoresis step was omitted, and replaced by purification and shearing of genomic DNA using the Genomic DNA Clean and Concentrator-10 kit (Zymo Research, USA). Approximately 5-10 µg of DNA was end repaired, then the DNA was purified a second time and ligated with pCCFOS. Approximately 1,500 colonies from the library were plated onto LB agar containing 15 µg·mL$^{-1}$ chloramphenicol then transferred to 96 well plates prior to PCR screening with primers targeting the flanking regions of the microcystin gene cluster.

Expression Plasmid Construction

A description of the construction of pFos-biTet-mcy plasmid follows:

Step 1: Construction of Homology Arm (HA)-mcyC'-KanR-HA

The region of mcyC (mcyC') not present on fosmid pFos-P12F11 was amplified from *Microcystis aeruginosa* sp. PCC 7806 genomic DNA using Velocity polymerase (Bioline, Australia) and primers mcyC'-NcoI-F and mcyC'-XbaI-R. Following purification with DNA Clean and Concentrator-5 kit (ZymoResearch, USA), the insert was digested with XbaI and NcoI (New England Biolabs, Australia), purified and ligated (T4 DNA ligase, New England Biolabs) into the respective sites of gel purified (Zymoclean Gel DNA Recovery kit, ZymoResearch) pET15b (Novagen, Australia), and was designated pET15b::mcyC'. This plasmid was then digested by BamHI and NdeI (New England Biolabs) and ligated with a kanamycin resistance cassette [amplified from pET28b (Novagen) using KanR-BamHI-F and KanR-NdeI-R] digested with the same enzymes. The resulting plasmid was designated pET15b::mcyC'-KanR. This plasmid was used as a template to amplify HA-mcyC'-KanR-HA using primers HR-mcyC'-F and HR-KanR-R. The resulting PCR product, HA-mcyC'-KanR-HA, was gel purified and electroporated into recombineering-proficient GB05-red, prepared as previously described, harbouring pFos-P12F11, prepared as previously described[1], for linear circular homologous recombineering (LCHR).

Step 2: Construction of HA-NruI-AmpR-HA

The ampicillin resistance cassette was amplified by Velocity DNA polymerase using primers HR-AmpR-NruI-F and HR-AmpR-R with pET15b as template, this amplicon was then purified as described above and used for LCHR with pFos-P10F4.

Step 3: Construction of HA1-TetR-Nru-HA2-AmpR-HA3

The tetracycline resistance cassette was amplified with primers TetR-EcoRI-F and TetR-NotI-R with plasmid pBR322 as template. EcoRI and NotI (New England Biolabs) were used to digest both insert and plasmid (pET28b) prior to gel purification and subsequent ligation; the resulting plasmid was designated pET28b::TetR.

This plasmid and the NruI-HA2-AmpR fragment [amplified from pET15b (Novagen) using primers AmpR-NotI-NruI-F and AmpR-XhoI-R] were then digested by NotI and XhoI (New England Biolabs) with subsequent ligation. The resulting plasmid was designated as pET28b::TetR-NruI-HA-AmpR.

This plasmid was used as template with HR-TetR-F HR-AmpR-R as primers to amplify HA1-TetR-NruI-HA2-AmpR-HA3. Homology arm 1 and 3 on this fragment were used for the homologous recombineering between this fragment and pFos-P10F4.

Step 4: Linearization of NruI-AmpR-mcyJ-mcyE-NruI

The 20 kb DNA fragment NruI-AmpR-mcyJ-mcyE-NruI was excised from pFos-P10F4-NruI by NruI restriction digest for LCHR (Step 5).

Step 5: Construction of pFos-mcy

The 600 bp mcy region common to both fosmids and homology arm 2 as described in step 3 were used to direct LCHR between linearized NruI-AmpR-mcyJ-mcyE-NruI (from pFos-P10F4) and pFos-P12F11-mcyC, leading to the integration of entire microcystin biosynthetic gene cluster in one fosmid, pFos-mcy Step 6: Engineering of Promoter Region in pFos-mcy Step 6.1: Construction of EcoRV-mcyA'-Ptet-AprR-Ptet-mcyD'-EcoRV The $Ptet_O$ promoter was amplified from pCC-Ptet-ltx[1], using primers TetProm-BglII-F and TetProm-NcoI-R, gel purified, digested with BglII and NcoI, gel purified, and ligated into the respective sites of pET28b. The pET28b::Ptet plasmid was digested by NcoI, and gel purified. The first 252 bp of mcyD gene (mcyD') was amplified using primers Gib-mcyD'-F and Gib-mcyD'-EcoRV-R, and cloned into pET28b::Ptet by Gibson assembly; the resulting plasmid was designated pET28b::Ptet-mcyD'. This plasmid was digested with BglII before Gibson assembly with mcyA' (first 138 bp of mcyA gene, amplified by PCR using primers Gib-mcyA'-F and Gib-mcyA'-EcoRV-R), AprR (apramycin resistance cassette, amplified by PCR using primers Gib-ApraR-F and Gib-ApraR-R) and Piet (amplified by PCR with Gib-Ptet-F and Gib-Ptet-R)

Step 6.2: Insertion of biTet (mcyA'-Ptet-AprR-Ptet-mcyD') into pFos-mcy

DNA fragment mcyA'-Ptet-AprR-Ptet-mcyD' was released from pET28b plasmid by EcoRV restriction digest, this fragment was inserted into pFos-mc by LCHR, replacing the native mc promoter, to generate pFos-biTet-mcy.

Fermentation Conditions

*E. coli* GB05-MtaA was transformed via electroporation with fosmid pFos-biTet-mcy to generate GB05-MtaA-pFos-biTet-mcy. Clones were selected on LB agar plates containing 20 $\mu g \cdot mL^{-1}$ apramycin, 25 μg·mL-1 ampicillin, and 15 $\mu g \cdot mL^{-1}$ chloramphenicol. A negative control strain (GB05-MtaA-pCC1FOS) was generated by transforming GB05-MtaA with the empty pCC1FOS plasmid (Epicentre, USA), under selection with 15 $\mu g \cdot mL^{-1}$ chloramphenicol. Both strains were cultured overnight at 30° C. with shaking (950 rpm, Eppendorf Thermomixer, Germany) in LB medium supplemented with 15 $\mu g \cdot mL^{-1}$ chloramphenicol. Overnight cultures were used to inoculate 50 mL LB medium containing 15 $\mu g \cdot mL^{-1}$ chloramphenicol at 1:100 dilution in 250 mL Erlenmeyer flasks. The cultures were incubated at 30° C. with shaking (200 rpm) until the OD600 reached 0.3. Cultures were then incubated at 18° C. with shaking (200 rpm) until the OD600 reached 0.5. Expression was induced via the addition 0.5 $\mu g \cdot mL^{-1}$ tetracycline and incubation continued for 4 days. Amberlite XAD-7 polymeric resin (2% v/v) was added to cultures to adsorb secreted metabolites, and incubation continued for a further 24 h. Cells and resin were harvested by centrifugation at 4,000 g for 30 min, and cell pellets stored at −20° C. prior to toxin extraction.

Feeding Experiment

Recombinant *E. coli* was cultured in M9 medium, and either 0.05 mg/mL L-leucine-5,5,5-$D_3$ (Cambridge isotope laboratories, USA) alone or both 0.05 mg/mL L-leucine-5,5,5-$D_3$ and 0.05 mg/mL L-arginine-guanido-$^{15}N_2$ (Cambridge isotope laboratories) were supplemented to confirm the incorporation of leucine and arginine into their respective positions in [D-Asp]microcystin-LR. Furthermore, either 0.5 mg/mL or 5 mg/mL β-methyl-aspartic acid (Sigma, Australia) was added to M9 medium to provide the methylated aspartic acid precursor essential for the production of microcystin-LR.

Extraction of Microcystin

Cell pellets were thawed on ice and resuspended in 6 mL of MilliQ water. Methanol was added to achieve an 80% aqueous methanol solution. Cells were disrupted by vortexing for 2 min then extracted by shaking (200 rpm) for 1 h at room temperature. Cell debris was removed by centrifugation (4,000 g), and supernatants filtered through Whatman No. 1 filters (185 mm) into Syncore dryer sample glass tubes (Buchi, Switzerland). Extracts were evaporated to 3 mL with a Syncore dryer (200 rpm, 35° C., pressure dropped from 93 to 40 mbar), transferred to scintillation vials and evaporated to dryness by a Rotavapor (Welch 2027, USA). Desiccated extracts were resuspended in 3 mL HPLC grade methanol, centrifuged at 16,100 g for 10 min then transferred to HPLC vials for analysis.

Analysis of Microcystin Production

LC-MS/MS analysis was performed on a Q-Exactive Plus mass spectrometer coupled to a U3000 UHPLC system (ThermoFisher Scientific, USA). 20 μL of sample solution was injected on to a Waters CSH C18 150×2.1 mm 1.9 micron column. Chromatography was performed at 40'C using 0.1% formic acid in water (A) against acetonitrile (B) at 300 $\mu L \cdot min^{-1}$ using the following gradient: Time 0=5% B, 5=38% B, 15.5=52% B, 20=95% B, 23=95%, 25=5%, followed by a 5 min equilibration at 5% prior to the next injection. Column eluate was directed into a HESI-2 probe maintained at 250° C. Sheath gas and auxiliary gas were 25 and 5 (ThermoFisher arbitrary units) respectively. Capillary temperature was 300° C. S-Lens was 60. Mass spectra were acquired in the positive ion mode over the range 350-1500 at a resolution setting of 70 k. Data dependent acquisition was used to obtain MS/MS data of the 8 most intense ions in the preceding full mass spectrum. An inclusion list was utilized to ensure MS/MS data was obtained on the analytes of interest (981.6000, 983.5000, 984.5000, 986.5000, 995.5560, 1024.5000, 1031.5000). Extracts from induced microcystin expression cultures were compared to negative controls, including uninduced microcystin expression cultures and induced cultures transformed with the empty fosmid.

Protein Phosphatase 2A (PP2A) Inhibition Assay

The method of this assay is modified from Heresztyn and Nicholson's PP2A method (Heresztyn and Nicholson, (2001), Water Research 35, 3049-3056). The inhibition capacity of microcystins over PP2A (Promega, Australia) was measured based on the relative activity of PP2A (compared with the control) on the substrate p-nitrophenetol phosphate (pNPP) when incubated with microcystins at certain concentrations. The enzyme solution was prepared by diluting the PP2A enzyme in 0.1 M Tris buffer, pH 7.0, with 40 mM DTT, 10 mM $MnCl_2$, 10 mg/mL BSA and deionized water in the ratio of 10:1:4:2:3 with 4 U/mL PP2A. The reaction buffer contained 0.4M Tris buffer, pH 8.1, 10 mM $MnCl_2$, 0.3 M $MgCl_2$, 10 mg/mL BSA in the ratio of 25:2:13:10. The substrate solution was prepared by adding 50 mM pNPP and 40 mM DTT into reaction buffer in the ratio of 4:1:5. Before the reaction, 10 μL samples and 10 μL enzyme solution was mixed in a 96 well microplate well and incubated at 37° C. for 5 min. The reaction was started by adding 100 μL of substrate solution into the well and incubated at 37° C. for 80 min. The controls replaced samples with deionized water, and blanks were performed by replacing enzyme solution with deionized water in the control. In the reaction mix the concentration of PP2A was 0.33 U/mL (except blank), and the concentration of microcystin in the final reaction mix was used to draw the inhibition curve and calculate microcystin concentration which cause 50% inhibition ($IC_{05}$).

1.3 Results and Discussion

The genes responsible for microcystin production in *M. aeruginosa* PCC 7806 are clustered and span 55 kb. Comprising ten genes, the pathway is transcribed as two divergent operons, mcyC-mcyA and mcyD-mcyJ, encoding one polyketide synthase (PKS), three non-ribosomal peptide synthetases (NRPS), and two hybrid PKS-NRPSs. To isolate the mcy gene cluster, a *M. aeruginosa* PCC 7806 genomic DNA fosmid library was constructed, followed by polymerase chain reaction (PCR) screening targeting two genes flanking the mcy cluster. Two positive clones were revealed (pFos-mcyJ-mcyE. 18.8 kb and pFos-mcyE-mcyC, 35.6 kb) covering 54 kb of the 55 kb gene cluster including a 600 bp overlap, with a small portion of mcyC absent from the latter clone. To reassemble the biosynthetic pathway, a cloning strategy was designed (FIG. 1). Briefly, mcyC was completed by linear-circular homologous recombineering (LCHR) of the missing region. To perform final reassembly of the pathway, two restriction sites were inserted by LCHR into pFos-mcyJ-mcyE, flanking these genes. LCHR was performed using restriction digest excised mcyJ-mcyE and pFos-mcyE-mcyC. The whole mcy gene cluster was reconstituted onto one plasmid, pFos-mcy.

Post-translational modification is an important consideration for expression of PKS- and NRPS-containing biosynthetic pathways. A phosphopantethienyl transferase (PPTase) activates these multimodular enzymes by the addition of a phosphopantethienyl linker to their carrier proteins to facilitate substrate attachment. A PPTase is not clustered with the mcy pathway, and native *E. coli* PPTases have limited specificity for modifying secondary metabolite synthetases. A promiscuous phosphopantethienyl transferase (MtaA), from the myxobacteria *Stigmatella aurantiaca* DW4/3-1, was integrated into the genome of *E. coli* GB2005 generating *E. coli* GB05-MtaA. Following transformation of *E. coli* GB05-MtaA with pFos-mcy (to generate GB05-MtaA-pFos-mcy), the confirmed clones were cultured under different temperatures (30° C., 25° C., 18° C.) for 3, 5, and 7 days, but no microcystin was detectable from the cell lysates of these cultures.

The promoter region between mcyA and mcyD responsible for transcription of genes involved in microcystin biosynthesis contains sequence motifs recognized by the global nitrogen-responsive transcription factor NtcA, which modulates expression of mcy genes with alterations of nitrogen availability. Light intensity and wavelength also affect mcy gene transcription which represents the other regulation factor in microcystin biosynthesis in *M. aeruginosa*. As no homologue of NtcA has been described in *E. coli*, it was considered unlikely that efficient heterologous expression of the mcy gene cluster could be achieved from its native promoter. To test this, transcriptional analysis was performed on mRNA extracted from fermentations with subsequent PCR amplification of cDNA targeting all genes within the cluster (Tables 2 and 3). Unexpectedly, transcripts from the native promoters were detected (FIGS. 2 and 3) even though no microcystin was detected by LC-MS. Therefore, to enhance expression of the microcystin biosynthetic enzymes, it was necessary to replace the native mcy promoters with promoters that perform efficiently in *E. coli.*

Since the transcript mcyD-mcyJ spans 35 kb, the T7 promoter was not an ideal candidate for this study. The versatile tetracycline-inducible promoter (Ptet$_O$) was considered to be a good alternative. To engineer the mcy pathway for expression in *E. coli*, a bi-directional Ptet$_O$ promoter (PbiTet) was constructed, flanked by partial mcyA and mcyD genes and restriction enzyme sites to direct LCHR of PbiTet with pFos-mcy (Table 4, FIG. 4). This promoter was inserted into pFos-mc replacing the native mcy promoter to enable the concurrent expression of both mcyA-mcyC and mcyD-mcyJ operons; this new plasmid was designated pFos-PbiTet-mcy.

TABLE 4

| Primers | Nucleotide Sequences |
|---|---|
| mcyC-screening-F | CACCTGTCTTGATGCTTATG (SEQ ID NO: 41) |
| mcyC-screening-R | CTATTGCCTCGGAATTATCTC (SEQ ID NO: 42) |
| mcyG-screening-F | GAGCATCAATCGCAGTCA (SEQ ID NO: 43) |
| mcyG-screening-R | GAAGCCATAATAGCATCCATC (SEQ ID NO: 44) |
| mcyC'-NcoI-F | CATGCCATGGTTACGACTGTTTTGGGTTGAGAAT (SEQ ID NO: 45) |
| mcyC'-XbaI-R | CAGCTCTAGAACATTCCGCTGGCGGATTTTT (SEQ ID NO: 46) |
| KanR-BamHI-F | CGCGGATCCGCGGAACCCCTATTTGTT (SEQ ID NO: 47) |
| KanR-NdeI-R | GGAATTCCATATGGACGCTCAGTGGAACGAA (SEQ ID NO: 48) |
| HR-mcyC'-F | CATTCCGCTGGCGGATTTTT (SEQ ID NO: 49) |
| HR-KanR-R | ATAGAATACTCAAGCTTGCATGCCTGCAGGTCGACTCTAGAGGATCCCACGCGGAACCCCTATTTGTTTA (SEQ ID NO: 50) |
| HR-AmpR-NruI-F | GAGCTTTGGGTAGGAATGATTTGAGTCTGATTCGTTAATATTTCGCGACCTATTTGTTTATTTTTCTA (SEQ ID NO: 51) |
| HR-AmpR-R | AATACGACTCACTATAGGGCGAATTCGAGCTCGGTACCCGGGGATCCCACCATGAGATTATCAAAAAGGA (SEQ ID NO: 52) |
| TetR-EcoRI-F | AATAGGCGTATCACGAGG (SEQ ID NO: 53) |
| TetR-NotI-R | ATAAGAATGCGGCCGCACGCGATGGATATGTTCT (SEQ ID NO: 54) |

TABLE 4-continued

| Primers | Nucleotide Sequences |
|---|---|
| AmpR-NotI-NruI-F | ATAAGAATGCGGCCGCTCGCGATCGGTGCGGGCCTCTTCG CTATTACGCCAGCTGGCGAAAGGGGGATGCATGAGATTATC AAAAAGGA (SEQ ID NO: 55) |
| AmpR-XhoI-R | CCGCTCGAGCCTATTTGTTTATTTTTCTA (SEQ ID NO: 56) |
| HR-TetR-F | <u>CAGTTAATCCGTTGTTTGGAATTAGTGGCGGTTTTATCGGAC C</u>TCATGTTTGACAGCTTATC (SEQ ID NO: 57) |
| HR-AmpR-R | <u>TTCTCCCTGAATTTCCGCCGCCATGGACTCTTTGGCGCTACCT</u> CCTATTTGTTTATTTTTCT (SEQ ID NO: 58) |
| TetProm-BglII-F | AGGCAGATCTCAATTCGTTCAAGCCGAATA (SEQ ID NO: 59) |
| TetProm-NcoI-R | TCTGCCATGGGTCGATCCTCTTCTCTATCACT (SEQ ID NO: 60) |
| Gib-mcyD'-F | <u>GATAGAGAAGAGGATCGAC</u>ATGGACTTTCAAGATAAAAAGA AC (SEQ ID NO: 61) |
| Gib-mcyD'-EcoRV-R | ATGATGATGATGGCTGCTGCGATATCCTGCTGGTTCCAGCG (SEQ ID NO: 62) |
| Gib-mcyA'-F | <u>TGATAGAGAAGAGGCACGATA</u>TGGAAGCACATCTGGTTTC (SEQ ID NO: 63) |
| Gib-mcyA'-EcoRV-R | <u>GCGTCCGGCGTAGAGGATCG</u>GATATCTGTAGAGATGACCTC AAG (SEQ ID NO: 64) |
| Gib-Ptet-F | TTAAGACCCACTTTCAC (SEQ ID NO: 65) |
| Gib-Ptet-R | ATCGTGCCTCTTCTC (SEQ ID NO: 66) |
| Gib-ApraR-F | <u>GAAAGTGGGTCTTAAG</u>CGAAAAAGGATGGATATAC (SEQ ID NO: 67) |
| Gib-ApraR-R | <u>GGCTTGAACGAATTGG</u>ATATAGTTCCTCCTTTCAG (SEQ ID NO: 68) |

List of primers used in this study to construct pFos-biTet-mcy. Bold sequences are Restriction sites, and underlined sequences are homology arms needed Ibr LCHR or Gibson cloning.

Figure 5:
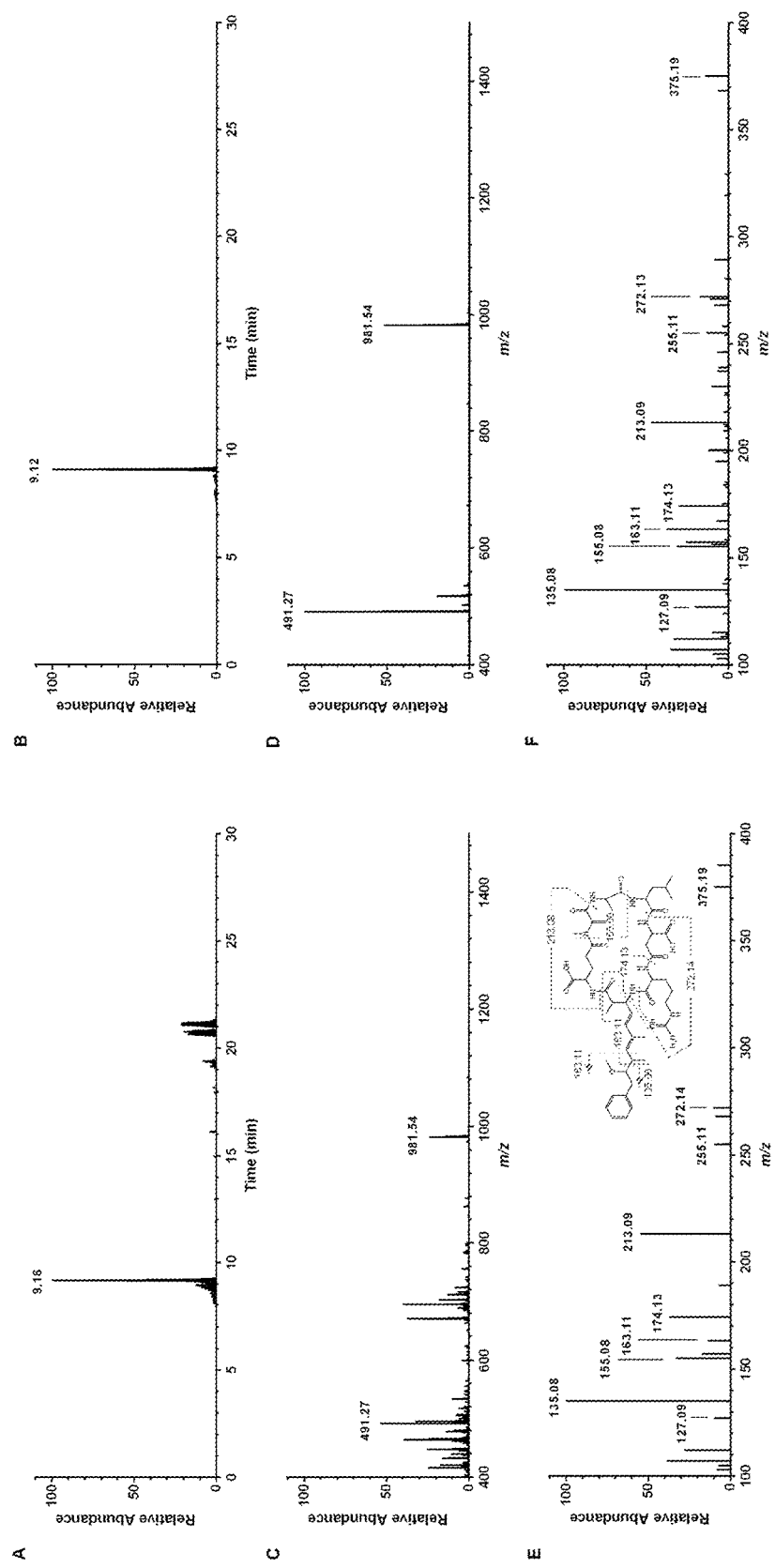
FIG. 5 shows LC-MS chromatograms and mass spectra of heterologously produced [D-Asp$^3$]microcystin-LR from *E. coli* GB05-MtaA compared to a [D-Asp$^3$]microcystin-LR standard. Chromatograms of heterologously produced [D-Asp$^3$]microcystin-LR (A) and standard (B). Mass spectra of heterologously produced[D-Asp$^3$]microcystin-LR at 9.16 min (C) and standard at 9.12 min (D). Tandem mass spectra (MS-MS) of ion 981.54 from heterologously produced [D-Asp$^3$]microcystin-LR (E) and standard (F).

Following transformation of *E. coli* GB05-MtaA with pFos-PbiTet-mcy (to generate GB05-MtaA-pFos-PbiTet-mcy), the expression strain was cultured at 30° C. to early log phase and cooled to 18° C. prior to induction with tetracycline. This was followed by 5 days incubation at 18° C., with Amberlite XAD-7 polymeric resin added one day prior to harvesting by centrifugation to adsorb extracellular metabolites. Microcystins were extracted using 80% aqueous methanol, and the extract was analyzed by liquid chromatography mass spectrometry (LC-MS). Comparison to a [D-Asp$^3$]microcystin-LR standard (Enzo Life Sciences, USA.) revealed the presence of a peak corresponding to [D-Asp$^3$]microcystin-LR, detected at 9.16 min with a m/z of 981 (FIG. 5). This peak was absent in methanolic extracts of the uninduced control (GB05-MtaA-pFos-PbiTet-mcy) and induced negative control [GB05-pCCFOS (empty fosmid)]. The identity of the 981 m/z ion was further verified by LC-MS/MS (FIG. 5), against the [D-Asp]microcystin-LR standard.

Five microcystin fragmentation ions are common among all microcystins, facilitating analytical verification of these compounds. These ions include $[C_9H_{11}O]^+$, the cleavage product of the Adda group with a methoxy substituent at m/z 135; $[C_{11}H_{15}O]^+$ at m/z 163; [Mdha+Ala+H]$^+$ at m/z 155; [Glu+Mdha+H]$^+$ at m/z 213; and $[C_{11}H_{15}O+Glu+Mdha]^+$ at m/z 375. LC-MS/MS analysis of methanolic extracts of induced GB05-MtaA-pFos-PbiTet-mcy revealed all five microcystin fragmentation ions, confirming that the precursor ion (m/z 981) was indeed a microcystin variant. Other characteristic ions, including [Mdha+Ala+H-CO]$^+$ at m/z 127 and [Arg+NH$_3$+H]$^+$ at m/z 174 were also observed following fragmentation of the precursor ion. Additionally, the observation of ions [D-Asp+Arg+H-NH$_3$]$^+$ at m/z 255 and [D-Asp+Arg+H]$^+$ at m/z 272 suggested that the 981 m/z precursor ion was [D-Asp]microcystin-LR. The 14 m/z difference between [D-Asp$^3$]microcystin-LR and microcystin-LR corresponds to the mass difference between D-Asp and Me-Asp at position 3 of these microcystin variants.

Figure 6:
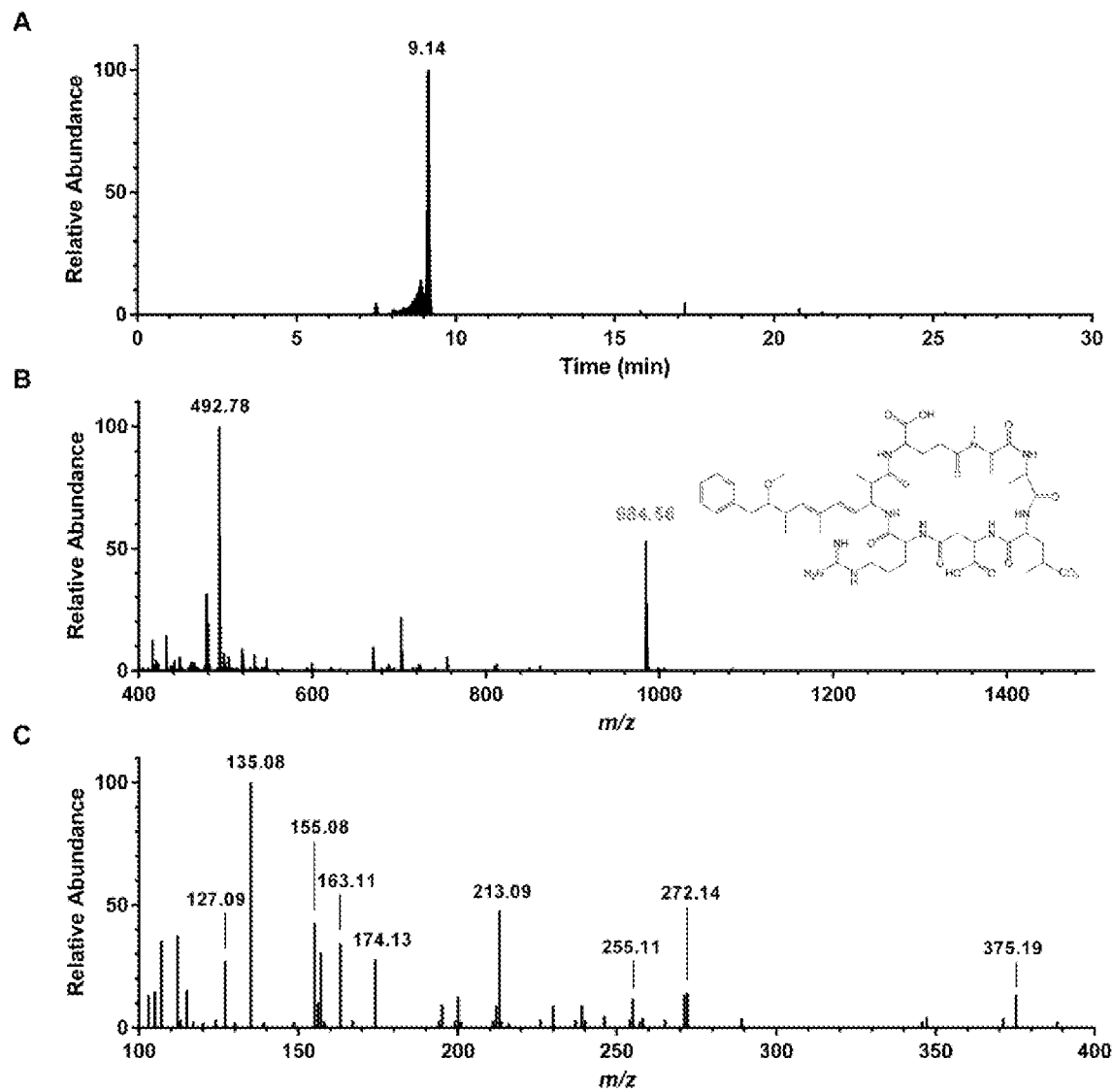
FIG. 6 shows LC-MS chromatograms and mass spectra of heterologously produced [D-Asp$^3$]microcystin-LR from *E. coli* GB05-MtaA cultured with L-leucine-5,5,5-D$_3$. (A) Extracted ion chromatogram for m/z=984.56 (predicted mass of isotope labeled [D-Asp$^3$]microcystin-LR). (B) Mass spectrum at 9.14 min. (C) Tandem mass spectrum (MS-MS) of ion 984.56.
Figure 7:
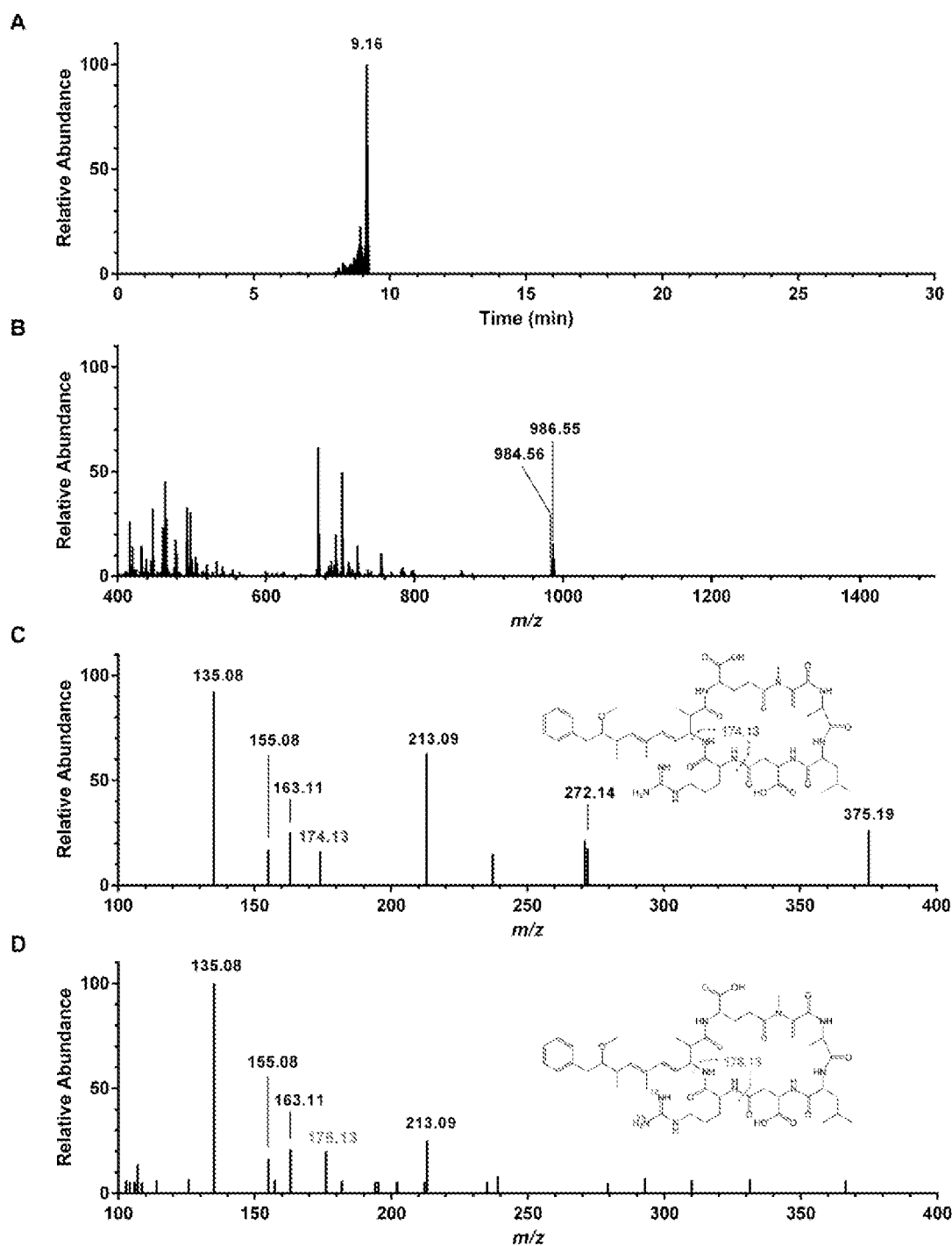
FIG. 7 shows LC-MS chromatograms and mass spectra of heterologously produced [D-Asp$^3$]microcystin-LR from *E. coli* GB05-MtaA cultured with L-leucine-5,5,5-D$_3$ and L-arginine-guanido-$^{15}$N$_2$. (A) Extracted ion chromatogram for m/z=984.56 and m/z=986.55 (predicted mass of isotope labeled [D-Asp]microcystin-LR). (B) Mass spectrum of isotope labeled [D-Asp$^3$]microcystin-LR at 9.16 min. (C) Tandem mass spectrum (MS-MS) of ion 984.56 from isotope labeled [D-Asp$^3$]microcystin-LR. (D) Tandem mass spectrum (MS-MS) of ion 986.55 from isotope labeled [D-Asp$^3$]microcystin-LR.

The presence of [D-Asp$^3$]microcystin-LR in GB05-MtaA-pFos-PbiTet-mcy extracts was further established by isotope labeled amino acid feeding experiments, during which the entire mass shift of 3 (L-Leu-5,5,5-D$_3$) and 2 (L-Arg-guanidino-$^{15}$N$_2$) was detected, and a m/z shift from 174 to 176 correspond to the ion [Arg+NH$_3$+H]$^+$ was detected when fed with L-Arg-guanidino-$^{15}$N$_2$, (FIGS. 6 and 7).

Figure 8:
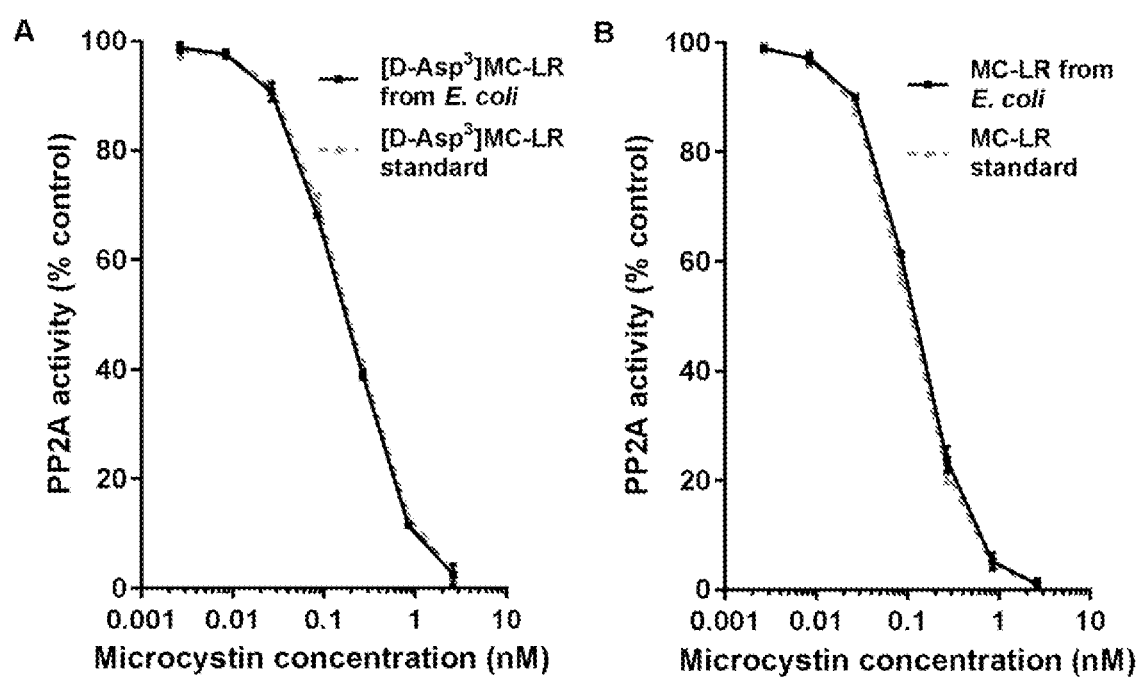
FIG. 8 shows inhibition curves of protein phosphatases 2A (PP2A) by [DAsp$^3$]microcystin-LR and microcystin-L produced by *E. coli*. (A) Inhibition of PP2A by [D-Asp$^3$] microcystin-LR and [D-Asp$^3$]microcystin-LR standard. (B) Inhibition of PP2A by microcystin-LR (conducted by using microcystin-LR with >94% congener purity) and microcystin-LR standard.

ADDA specific enzyme-linked immunosorbent assay (ELISA) is an immunoassay used for detection and quantification of microcystins and nodularins in water samples. This assay was carried out and the result revealed the occurrence of ADDA group in [D-Asp$^3$]microcystin-LR from the recombinant *E. coli*. ELISA additionally quantified the yield of [D-Asp$^3$]microcystin-LR at 65±7 µg/L. To confirm biological activity of the heterologous produced [D-Asp$^3$]microcystin-LR, a protein phosphatase 2A (PP2A) inhibition assay was conducted, which mimics the mechanism whereby microcystins elicit toxicity in vertebrates. Strong inhibition of PP2A was observed when heterologously produced [D-Asp$^3$]microcystin-LR was added into the reaction, and the IC$_{50}$ was 0.17 nM (μg/L) [D-Asp$^3$] microcystin-LR when the assays were performed with 0.33 mU/mL phosphatase as shown in FIG. 8.

To optimize toxin yields, different culture conditions were tested. Fermentation of *E. coli* GB05-MtaA-pFos-PbiTet-mcy was performed in Terrific Broth (TB) and M9 minimal medium. The yield of [D-Asp$^3$]microcystin-LR was approximately 250% (TB) and 10% (M9) respectively of the total yields obtained using Lysogeny broth (LB) (Table 5).

TABLE 5

|  | LB | TB | M9 |
|---|---|---|---|
| Yield (μg/L) | 65 ± 7 | 162 ± 23 | 6.5 ± 0.3 |

Quantification by ELISA of [D-Asp3]microcystin-LR from different medium (performed by Sydney Water Corporation).

Under laboratory conditions, *M. aeruginosa* PCC 7806 primarily produces two toxin isoforms; microcystin-LR and [D-Asp$^3$]microcystin-LR, which lacks a methyl group on aspartic acid at position 3. It is known that D-erythro-β-methyl-iso-aspartic acid is absent in *E. coli*, which explains why microcystin-LR was not produced in our heterologous system. Limited substrate availability for PKS and NRPS products has been raised previously as a main shortcoming of heterologous expression in *E. coli*. The absence of an essential precursor typically results in the failure of heterologous expression, however, in the present case the synthetase incorporated aspartic acid in the place of D-erythro-β-methyl-iso-aspartic acid. [D-Asp$^3$]microcystin-LR is a key product required for toxicology studies. Separation of this variant and microcystin-LR from the native producer can be troublesome due to the similarity of their chemistries. The successful production of microcystins in *E. coli* provides an excellent alternative for the acquisition of pure [D-Asp$^3$]microcystin-LR. This inspires a new method for directing the biosynthesis of a natural product towards a specific analogue via substrate limitation in a heterologous host.

Figure 9:
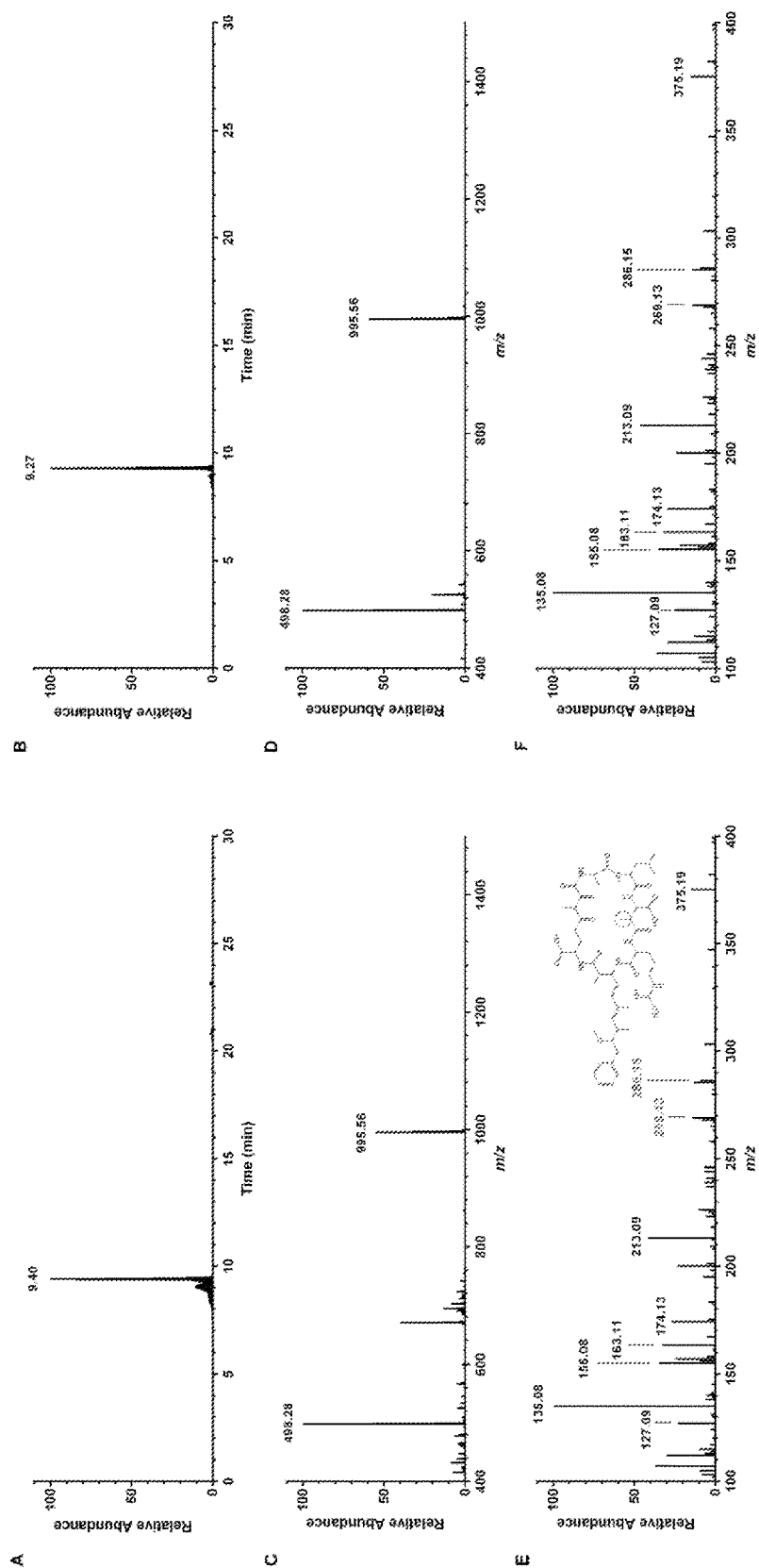
FIG. 9 shows LC-MS analysis of heterologously produced microcystin-LR and a standard. Chromatograms of heterologously produced microcystin-LR (A) and standard (B). Mass spectra of heterologously produced microcystin-LR at 9.40 min (C) and standard at 9.27 min (D). Tandem mass spectra (MS-MS) of ion 995.56 from heterologously produced microcystin-LR (E) and standard (F).

Aside from the prevention of unwanted substrate incorporation, the heterologous expression system developed also offers an alternative to direct the biosynthesis of a desired microcystin variant simply by adding particular precursors. As β-methyl-aspartic acid is absent from *E. coli*, and the occurrence of a methyl group on β position of aspartic acid is how microcystin-LR varies from [D-Asp$^3$]microcystin-LR, the addition of this amino acid is a promising way for microcystin-LR biosynthesis in *E. coli* (FIG. 9). To minimize interference by amino acids in the culture medium, fermentations were conducted in M9 minimal medium supplemented with 500 mg/L β-methyl-aspartic acid as described above. Fermentation in this medium resulted in the production of 40.98±4.64 μg/L of total microcystin, however when supplemented with 10-fold less β-methyl-aspartic acid (50 mg L$^{-1}$) production was halved. Supplementation resulted in ~96% microcystin-LR and ~4% [D-Asp$^3$]microcystin-LR. These changes demonstrate how titrating the amount of substrate supplementation enables variation of the ratio of microcystin-LR produced among total microcystins. Subsequent PP2A assay revealed this *E. coli* produced microcystin-LR was active, and demonstrated stronger inhibition capacity than [D-Asp$^3$]microcystin-LR with the IC$_{50}$ of 0.12 nM (μg/L) microcystin-LR for 0.33 mU/mL phosphatase (FIG. 8).

The existing microcystin purification technique employs consecutive rounds of chromatography; furthermore, to isolate specific microcystin analogues, different types of chromatography (TLC, HPLC with normal column and reverse phase column) utilizing several solvent changes are typically necessary for each step to emphasize particular polarities of the analogues (Lawton et al. (2001), Journal of chromatography A 912, 191-209). The heterologous production of high purity microcystin-LR via substrate supplementation is much more efficient than the complex purification required to isolate microcystin-LR from cyanobacteria.

Figure 3:
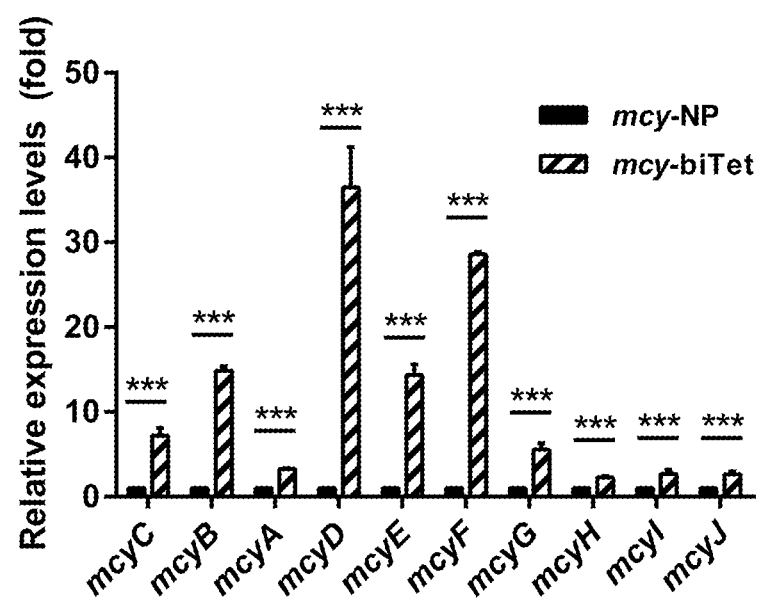
FIG. 3 is a graph showing relative quantification of mcy genes expression (RT-qPCR). RT-qPCR was done using cDNA as template, reverse transcribed from mRNA extracted from *E. coli* GB05-MtaA-pFos-mcy (native promoter, NP) and GB05-MtaA-pFos-biTet-mcy (bi-directional et promoter, biTet). The gene expression level of genes in NP was normalized to one fold, and gene expression level in biTet was shown as fold change relative to native promoter. The mean±SD of triplicate experiment was shown as bar value. (*** represents P<0.001 by Student's t test analysis, GraphPad Prism 6).
Figure 4:
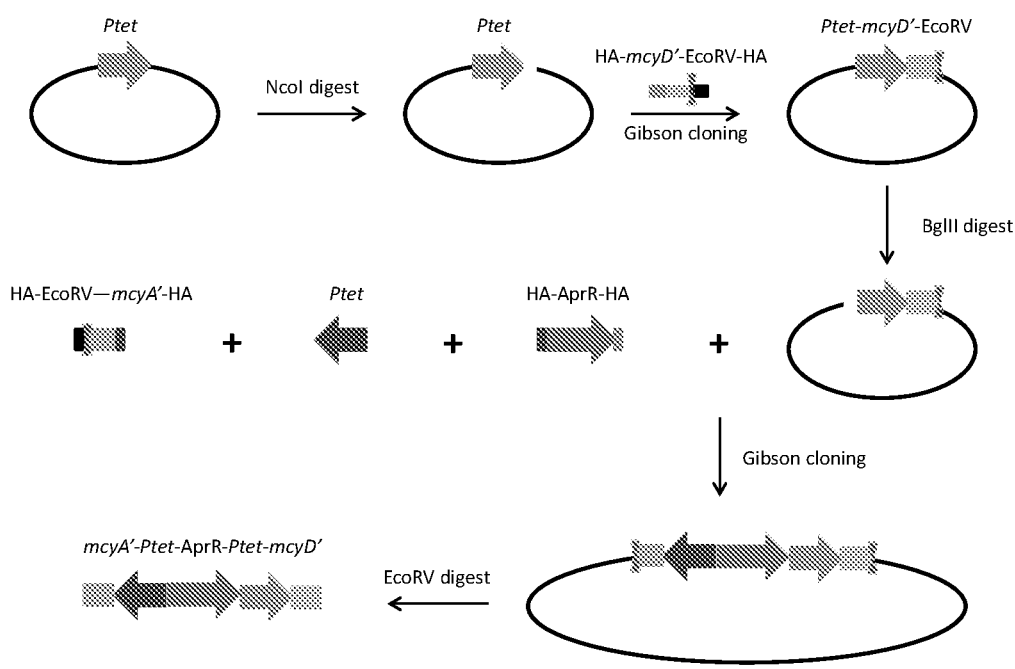
FIG. 4 is a flow diagram showing construction of the biTet promoter. The plasmid pET28b::Ptet was linearized by NcoI digest for the insertion of mcyD'-EcoRV fragment by Gibson cloning. Subsequently, this plasmid was linearized by BglII digest, and Gibson cloning was conducted to assemble this linearized plasmid, HA-EcoRV-mcyA'-HA fragment, Piet fragment, and HA-AprR-HA fragment. The resulting plasmid contained the bi-directional tet promoter (biTet) flanked by partial mcyA and mcyD genes as homology arms for further LCHR with apramycin resistant cassette as selection marker.

The heterologous expression of cyanobacterial natural products is challenging due to codon bias issues and the general lack of information regarding their biosynthesis. This study revealed that despite the native mc promoter being functional in *E. coli*, it is not suitable for the heterologous expression of microcystin synthetase [Expression levels were 7-(mcyC), 15-(mcyB), 3-(mcyA), 36-(mcyD), 14-(mcyE), 29-(mcyF), 6-(mcyG), 2-(mcyH), 3-(mcyI), and 3-(mcyJ) fold lower when driven by native promoter compared to that from biTet promoter (Table 3, FIG. 3)]. Notwithstanding, functional expression from the native mcy promoter is highly undesirable due to uncontrollable induction conditions. Due to the product of the pathway being highly toxic, clear regulatory mechanisms and strict production control are indispensable. These results show that [D-Asp$^3$]microcystin-LR is only produced by *E. coli* GB05-MtaA-pFos-PbiTet-mcy following induction by tetracycline, suggesting the TetR repressor strictly regulates the expression of the biosynthesis pathway and serves as a sufficient measure for safety control.

Under laboratory conditions, production of microcystin by M *aeruginosa* PCC 7806 is 0.65-2.2 fg/cell/day, whereas only 0.0007-0.0059 fg/cell/day (LB>TB>M9) was produced by the recombinant *E. coli*. When considering the fast growth rate and high cell density of *E. coli*, the yield from this heterologous host can reach 1.3-32.5 μg/L/day (TB>LB>M9), which is vastly superior to the yield of 5.7-16.7 μg/L/day from *M. aeruginosa*. The microcystin expression platform described herein is more rapid, more efficient and more economical than traditional chromatographic methods used to purify the toxin from slow growing cyanobacterial cultures and complex bloom samples.

Bloom-forming freshwater cyanobacteria are notorious due to their capacity to produce toxins, which contaminate water resources and endanger the health of humans and animals. These experiments have demonstrated the production of a large, complex, near-ubiquitous fresh water toxin, microcystin, using an inducible heterologous expression system. The heterologous expression platform is a stable and efficient method for producing [D-Asp$^3$]microcystin-LR and microcystin-LR, and will ultimately benefit the global study of microcystin biosynthesis, detection, and toxicology. This platform additionally provides access to other microcystin variants through a tightly-regulated, highly controllable expression system, and also establishes the foundation for producing other toxins and natural products from cyanobacteria.

Example Two

The production of D-erythro-b-methyl-aspartic acid is required for microcystin-LR production. It has previously been noted in the literature that ΔmcyI/ΔmcyJ would not affect the production of [D-Asp$^3$]microcystin-LR.

Gene knockout studies conducted by the present inventors (data not shown) has revealed that mcyI and mcyH are each needed to produce any variant of microcystin suggesting their involvement in microcystin production (not just tailoring), possibly via stabilizing the megasynthethase (NRPS-PKS).

SEQUENCE LISTING (96 sequences)

SEQ ID NO: 1 - DNA, 20 bp, Artificial Sequence
  Synthetic oligonucleotide
cacctgtcttgatgcttatg

SEQ ID NO: 2 - DNA, 21 bp, Artificial Sequence
  Synthetic oligonucleotide
ctattgcctcggaattatctc

SEQ ID NO: 3 - DNA, 20 bp, Artificial Sequence
  Synthetic oligonucleotide
ctgaggggattacggattga

SEQ ID NO: 4 - DNA, 20 bp, Artificial Sequence
  Synthetic oligonucleotide
accatataagcgggcagttg

SEQ ID NO: 5 - DNA, 40 bp, Artificial Sequence
  Synthetic oligonucleotide
tgatagagaagaggcacgatatggaagcacatctggtttc

SEQ ID NO: 6 - DNA, 44 bp, Artificial Sequence
  Synthetic oligonucleotide
gcgtccggcgtagaggatcggatatctgtagagatgacctcaag

SEQ ID NO: 7 - DNA, 43 bp, Artificial Sequence
  Synthetic oligonucleotide
gatagagaagaggatcgacatggactttcaagataaaaagaac

SEQ ID NO: 8 - DNA, 41 bp, Artificial Sequence
  Synthetic oligonucleotide
atgatgatgatggctgctgcgatatcctgctggttccagcg

SEQ ID NO: 9 - DNA, 16 bp, Artificial Sequence
  Synthetic oligonucleotide
tgtgccagatgaaccc

SEQ ID NO: 10 - DNA, 16 bp, Artificial Sequence
  Synthetic oligonucleotide
gagcaatgcgaacagc

SEQ ID NO: 11 - DNA, 24 bp, Artificial Sequence
  Synthetic oligonucleotide
ccaagtcaatctggaacatctcaa

SEQ ID NO: 12 - DNA, 24 bp, Artificial Sequence
  Synthetic oligonucleotide
ataatgagccgtacaacagccaat

SEQ ID NO: 13 - DNA, 33 bp, Artificial Sequence
  Synthetic oligonucleotide
cggcagccatatggaacagggattatttagcag

SEQ ID NO: 14 - DNA, 36 bp, Artificial Sequence
  Synthetic oligonucleotide
gtggtggtgctcgagttaatggcgacggctccgatt

SEQ ID NO: 15 - DNA, 24 bp, Artificial Sequence
  Synthetic oligonucleotide
caaacaccggattatgaaaaggta

SEQ ID NO: 16 - DNA, 19 bp, Artificial Sequence
  Synthetic oligonucleotide
aaccttcgcctggttcgat

SEQ ID NO: 17 - DNA, 21 bp, Artificial Sequence
  Synthetic oligonucleotide
tggctgaatcggactttgttt

SEQ ID NO: 18 - DNA, 20 bp, Artificial Sequence
  Synthetic oligonucleotide
aacatttcccgcgtttcact

SEQ ID NO: 19 - DNA, 21 bp, Artificial Sequence
  Synthetic oligonucleotide
tgcggaagcttttcgagtttt

SEQ ID NO: 20 - DNA, 22 bp, Artificial Sequence
  Synthetic oligonucleotide
tctaggcaaacaatccgctaca

SEQ ID NO: 21 - DNA, 23 bp, Artificial Sequence
  Synthetic oligonucleotide
ttgtttcacttgtgttccctcaa

SEQ ID NO: 22 - DNA, 20 bp, Artificial Sequence
  Synthetic oligonucleotide
ggcttctcccccgacaatta

SEQ ID NO: 23 - DNA, 20 bp, Artificial Sequence
  Synthetic oligonucleotide
ctgaggggattacggattga

SEQ ID NO: 24 - DNA, 20 bp, Artificial Sequence
  Synthetic oligonucleotide
accatataagcgggcagttg

SEQ ID NO: 25 - DNA, 18 bp, Artificial Sequence
  Synthetic oligonucleotide
gcgacggccaatgatgtc

SEQ ID NO: 26 - DNA, 15 bp, Artificial Sequence
  Synthetic oligonucleotide
gagggcgcgggtttg

SEQ ID NO: 27 - DNA, 23 bp, Artificial Sequence
  Synthetic oligonucleotide
agttagcaacgggagacatgatc

SEQ ID NO: 28 - DNA, 25 bp, Artificial Sequence
  Synthetic oligonucleotide
taaaaccggtagctggaaatacaat

SEQ ID NO: 29 - DNA, 19 bp, Artificial Sequence
  Synthetic oligonucleotide
ataccgttgacggcggttt

SEQ ID NO: 30 - DNA, 22 bp, Artificial Sequence
  Synthetic oligonucleotide
agggctaaaggatgacgacaaa

SEQ ID NO: 31 - DNA, 24 bp, Artificial Sequence
  Synthetic oligonucleotide
ccaagtcaatctggaacatctcaa

SEQ ID NO: 32 - DNA, 24 bp, Artificial Sequence
  Synthetic oligonucleotide
ataatgagccgtacaacagccaat

SEQ ID NO: 33 - DNA, 21 bp, Artificial Sequence
  Synthetic oligonucleotide
cagccgctattttaggccata

SEQ ID NO: 34 - DNA, 20 bp, Artificial Sequence
  Synthetic oligonucleotide
cctcgatggctgaccagttt

SEQ ID NO: 35 - DNA, 24 bp, Artificial Sequence
  Synthetic oligonucleotide
caaacaccggattatgaaaaggta

SEQ ID NO: 36 - DNA, 19 bp, Artificial Sequence
  Synthetic oligonucleotide
aaccttcgcctggttcgat

SEQ ID NO: 37 - DNA, 21 bp, Artificial Sequence
  Synthetic oligonucleotide
tggctgaatcggactttgttt

SEQ ID NO: 38 - DNA, 20 bp, Artificial Sequence
  Synthetic oligonucleotide
aacatttcccgcgtttcact

SEQ ID NO: 39 - DNA, 20 bp, Artificial Sequence
  Synthetic oligonucleotide
gcggaagcttttcgagtttt

SEQ ID NO: 40 - DNA, 22 bp, Artificial Sequence
  Synthetic oligonucleotide
tctaggcaaacaatccgctaca

SEQ ID NO: 41 - DNA, 20 bp, Artificial Sequence
  Synthetic oligonucleotide
cacctgtcttgatgcttatg

SEQ ID NO: 42 - DNA, 21 bp, Artificial Sequence
  Synthetic oligonucleotide
ctattgcctcggaattatctc

SEQ ID NO: 43 - DNA, 18 bp, Artificial Sequence
  Synthetic oligonucleotide
gagcatcaatcgcagtca

SEQ ID NO: 44 - DNA, 21 bp, Artificial Sequence
  Synthetic oligonucleotide
gaagccataatagcatccatc

SEQ ID NO: 45 - DNA, 34 bp, Artificial Sequence
  Synthetic oligonucleotide
catgccatggttacgactgttttgggttgagaat

SEQ ID NO: 46 - DNA, 31 bp, Artificial Sequence
  Synthetic oligonucleotide
cagctctagaacattccgctggcggattttt

SEQ ID NO: 47 - DNA, 27 bp, Artificial Sequence
  Synthetic oligonucleotide
cgcggatccgcggaacccctatttgtt

SEQ ID NO: 48 - DNA, 31 bp, Artificial Sequence
  Synthetic oligonucleotide
ggaattccatatggacgctcagtggaacgaa

SEQ ID NO: 49 - DNA, 20 bp, Artificial Sequence
  Synthetic oligonucleotide
cattccgctggcggattttt

SEQ ID NO: 50 - DNA, 70 bp, Artificial Sequence
  Synthetic oligonucleotide
atagaatactcaagcttgcatgcctgcaggtcgactctagaggatcccacgcggaacccctatttgttta

SEQ ID NO: 51 - DNA, 68 bp, Artificial Sequence
  Synthetic oligonucleotide
gagctttgggtaggaatgatttgagtctgattcgttaatatttcgcgacctatttgtttatttttcta

SEQ ID NO: 52 - DNA, 70 bp, Artificial Sequence
  Synthetic oligonucleotide
aatacgactcactatagggcgaattcgagctcggtacccggggatcccaccatgagattatcaaaaagga

SEQ ID NO: 53 - DNA, 18 bp, Artificial Sequence
  Synthetic oligonucleotide
aataggcgtatcacgagg

SEQ ID NO: 54 - DNA, 34 bp, Artificial Sequence
  Synthetic oligonucleotide
ataagaatgcggccgcacgcgatggatatgttct

SEQ ID NO: 55 - DNA, 89 bp, Artificial Sequence
  Synthetic oligonucleotide
ataagaatgcggccgctcgcgatcggtgcgggcctcttcgctattacgccagctggcgaaagggggatgcatgagattatcaaaaagga

SEQ ID NO: 56 - DNA, 29 bp, Artificial Sequence
  Synthetic oligonucleotide
ccgctcgagcctatttgtttatttttcta

SEQ ID NO: 57 - DNA, 62 bp, Artificial Sequence
  Synthetic oligonucleotide
cagttaatccgttgtttggaattagtggcggttttatcggacctcatgtttgacagcttatc

SEQ ID NO: 58 - DNA, 62 bp, Artificial Sequence
  Synthetic oligonucleotide
ttctccctgaatttccgccgccatggactctttggcgctacctcctatttgtttatttttct

SEQ ID NO: 59 - DNA, 30 bp, Artificial Sequence
  Synthetic oligonucleotide
aggcagatctcaattcgttcaagccgaata

SEQ ID NO: 60 - DNA, 32 bp, Artificial Sequence
  Synthetic oligonucleotide
tctgccatgggtcgatcctcttctctatcact

SEQ ID NO: 61 - DNA, 43 bp, Artificial Sequence; identical to SEQ ID NO: 7
  Synthetic oligonucleotide

SEQ ID NO: 62 - DNA, 41 bp, Artificial Sequence; identical to SEQ ID NO: 8
  Synthetic oligonucleotide

SEQ ID NO: 63 - DNA, 40 bp, Artificial Sequence; identical to SEQ ID NO: 5
  Synthetic oligonucleotide

SEQ ID NO: 64 - DNA, 44 bp, Artificial Sequence; identical to SEQ ID NO: 6
  Synthetic oligonucleotide

SEQ ID NO: 65 - DNA, 17 bp, Artificial Sequence
  Synthetic oligonucleotide
ttaagacccactttcac

SEQ ID NO: 66 - DNA, 15 bp, Artificial Sequence
  Synthetic oligonucleotide
atcgtgcctcttctc

SEQ ID NO: 67 - DNA, 35 bp, Artificial Sequence
  Synthetic oligonucleotide
gaaagtgggtcttaagcgaaaaaggatggatatac

SEQ ID NO: 68 - DNA, 35 bp, Artificial Sequence
  Synthetic oligonucleotide
ggcttgaacgaattggatatagttcctcctttcag

SEQ ID NO: 69 - DNA, 756 bp, Microcystis aeruginosa
atgaagacaaaactaccgattcttggcgttttagggggtatgggcccagtggttaccgccgaatttcttaagtcgatttatgaatataatccttttattgataaggaacaagaatcccctaatgtcatcgttttttcttttccctctgcacccgatcgcacaggttctattgatagtggaaaagaaagagaatttattgattttatccaagtcaatctagaacatctcaataaactggctgattgcatagtcattggctgttgtacggctcattatgctctacctcagatctccgaaaatctgaaggataaacttctttccttaattaaaatagcggatcaagaactccaagaatataatgaacctacccttttacttgctagtacagggacttaccagaaaaaattatttcaggaaggctgcaccaccgcagatctgattatttctctctcagaaagcgatcaaaagttgattcatgaaatgatctataaagtgctaaaaagaggacacgatccgttaagtattcttagggatatagaagcattattagagaaatataacactcgctcctatatttctgggtgtaccgaatttcatctcttaacaaaatctctcaaactcaaaggaattgactccattaaagcgatcgatcctttaagtaccatcgctcaaaacttttctcagttaatcatcaaacaagctcaggtagaccgagggaccgactgccatcaaccttcaaccccaaaaagcccttga

SEQ ID NO: 70 - DNA, 756 bp, Microcystis aeruginosa; identical to SEQ ID NO: 69

SEQ ID NO: 71 - DNA, 63626 bp, Microcystis aeruginosa
aggtaaccagtcgtaagttagaaggggcctatcccacttataatcagttaattcctaaatccttcgatcgctctttggttttagaccgcaaacagttaatccgttgtttggaattagtggcggttttatcggaccaaaagaataatttagttaagtttagtctcgatagcgaaaatgaccgtttatccctagcggtggaatctcccgatttaggtagcgccaaagagtccatggcggcggaaattcagggagaaagtggcgatattgcctttaatgttaaatacttgatggacggtttgaaggctttacctaataatgatattcaaatgcagttaaatgctagtacccaaccggttatttttacccccttgggaggtttaaagatgacctatttggtgatgccggtacaaattcgtcagtagttctgacttaattggaactgtgggatctatttttaacctatcccatttttgattgtaagtagctggttataattaaattgaagatagattttggtgtcgatccccccttaatccccccttgataaggggggtgtcgatccctccttaatactagggctaattcattctccgaatctacttcttttttttgctacctttaatcgcttacgaggtaagttagggagcaggggagtaccggtttttgctctcatagtaggttgattcatgaatcaacctacagagcacgacgttttgacaaattttcagctatgtatttccgagaaatcgactaaaaacgttaccagataaggagttgagagaatgacataagagagaatgaatcagccctacatctggggggtgactagcgatttctagcttaacctgcgttcgggataacgctatagaagggactgttagaaaaccttggccaattctagattctcaactccttgattaatagccaatcgctaacaagaagtcccccctatctatcgactgggttttacatcaatctgcttaaaccgaactcagtttaatttaggcttttctgccgaaaacaaaagataatcatcaaacgccataaaccaaccccgatttcttgaccaagcttcgagtcctgggttatctttctggagatcgataactaaatcatgcttactaattccttggctaatctgggcaaaataatgaaccattgccggccaaacatattcactaatagataaagcttggatattaacaaatccatgctttttgagtttttctacataaatatgtcggtcgtattgattaggaaagggaatacacattttcttactattaacccgcagccagaagttaatttctcgacccactctaggcaaacaatccgctacagccaaccttccaccgggctgcaaaactcgaaaagcttccgcaaaaaaatcctcacgagtgtcaaaatgaaaagcacattctaaagcggtcaacttatcaaaagaattctcaggaaaggggatttgagtagccgagccgacttgaagttttatcctgtccgataaccctgctttagctactctttcttgagcaatttctacttgtaactcagttgtatttagaccaataattgagctaacattgttttctcttacccagagtaaatcctgttcagcaaaaccgaaacccacatctaaaaggtgatctccggctttaagttcggctacttcggctaatttacgcgctaaagcggcacaagctccgttataagttgtttcttctttccaataaccaaaattaagccattggggaaaattaggatcctgaagatgaggatcgcgtttcgctatattagtatatagttcagaaacttgaaactgatcttgcaaaaacgccatttctcgaaccggattaaggataaattgtttgatgattgcccagcgattacgccattcatctttgaggggaattttgccgatgttttccaaattattatcctcctaaggattttgcagaaatattgccatttttaactaaccgaatccctgagattctctagatgctttaaaaaagattccacgcctccggattaatcatataaggaggcttctctccccgaagcacttgtaatatttgattcgccgccgaaacagcagccgctagactcgcttcaggggttactccggctaaatgaggtgagagaatgacattctcaaaattatataagggattatctaaagccggcggttctggttcaaagacatctagggcgcatccggatatcaatttttgattaagggcgatccctaaatccttttcacaaacgacttttccccgggaggtattaattaaaaaagctgttggtttcatctttttaaaaactgatatattaaacatttcccgcgtttcacttgttagttcagtatgcaaagaaacaaagtccgattcagccagaagaacatctaaatctttgagcaaagttgctcctactgtctccgctttgctggctggaacatagggatcataagctaatactctcatccccagtgctaggttacatttgtgagccaccagagtaccaattcttcctaaacctacaataccaagggtcttgttttcgagttgaatcggttgcatctgattgcgaattaaatagttaccctttttcacacaatgatctaaaaaagggagctttttagcaagggctaaaatcatagataaggtgtgttctgctacagctgtagttgacattccaggattattaacaacgataaccccctgttctgttgctgccataatatcaatagaatctgtgccaaatccagaggtactaattacttttaagtgttttgctaatcggattgatgaagcctctaagttattaggataacgcacaaatacgccagatacttcttgaatggcctcattaatttcctccggtgtagggttggacaaaatctctatattagtagattcttcaagaagtttttgccccgcttcatcatacatttttccgattaaaagaaccctgggtttttgaatatccatagtcagagtttttggtgaagtagtagtcatcgtaatttttcctaaattgaggtttagcaatgaaacagttacagagcttttgaggctcgataatcatctatggaaagaagtcgccaactagaatcctctaaaagttctaacacccattgatgatacttaaataaactttctctatgtcctacgctaataaaagttgtctgtgctttttgtaactgctgatataaggtttgttcgttgttcaaatctaaagcacttgtggcttcatctaagattacatagcggggatgggttactaacaatcgggcaaaagcaaggcgttgttgttctcctaaagataatatattttcccaaggaacttccgcatcaaagccatgaacttttgtggctatattttgaagattaactttttgtaaaaccgattcaagttctccatcggtcatttcacgggttgttttaggataaagtaactgttctctgagagttcctaaaataatataaggacgttgaggtaaaaagagaaattgttctaagggaggtcgttttaaacaaccagttcctgcattccataagccagcaatagctcttaatagagaacttttacctcgtccactcggtccgacaattaataaaccttcgcctggttcgatagatagggataaatgttgaacaattaccttttcataatccggtgtttgtaaagtaacatcctcaaacttgatctgattttgttcaagggttttaatggtactagcatccttggtttgttggccgatttcttctaaggccgacgaaaattcagatagacgctcaacataactggaaaatctgcccaaagaaccaaattcaaggattaactcagaaaaaccattagcaaacatactgcaagcaataatagcctgattaacttgtccgaaatcaatttccccccgaatataggctggagcgaagacaacaaagggaaatatttgaataactgagcgataacctcgactaaaaatgtcttgatttttctcccaatcaatcttactgagagaatttctgacgagattattaaatcgacgttgaatgattttcaactcttgattttcgccttgaaaaaaggcaatagattcagcatgattacgaacatgagttaaagtgtaggtgtaattagctttggattccaattcttcttgactaatcttatctaattctcgacttaaataaacagcaattaggttgccgacaattgtataagccactaaaatcaaggcggctagtcgggaaatcgaaaaaagaattactaaaaaagtcgtcatttctaagactttttctaataaaacagaaccaaaattaacagcatttctagcaatgggttctatttcttgggctatcctttgatccggattatccacatcggatctaaaattaattttataataggcgcgatcactcaaatattgggtaataacctgctgatttagccattcataccaatccagaataattctttttttaacaaatttagaaaatgcagtaaacagggtaattaaaagtaatcctaagccataaaataataaaattgtcagaaacttagaggcatttttatcttgaataataacatcaactaaatagcgattaacgaagctattaactgcattagaggcaaccagtccaacaattactaacaggaggagaaacagcattccccatgaacttattacctctgaaaatgtccttcctttaggatcagttggataccagtaaggagcggcaatcaatttcagattgtcaaaaaattgatgagagctttttacggtttcttgttgaaaaaatggagtttgcatagtttgaatatagggtaacttttaggaaatgccttgaattttttttaacttcaagctttctaacttcaaggcttaggattatttaatctcctaaaaaagcctccaaatcagtaagttcttgtaagattaaatcctcactaatctcctgctgaacttcagtgaagttaatcatcttctcggctgttttttgaactttttcaccgaaaatacggtcaaacagataatcaactaagcgtctaatattaggaaagtcaaagactaaagaagtgggtaagagaacttctaatcttttctctaaacgatttttcaattcaatagaggatagggaatcaatccccatttctatcaatccctgttctgtatctggcatagatttaatccctaaaatcattctgacttgtttgctaacatattctaacaaatattcccgacgttctccgaaaggcatctcctctaaaagatgcagtacagagtctgattcttgaacagaattaatgggaatttctgagagtcctaaattttttaggagtggtttctcgcctttaaattgatagatatttttgaaacgaacccaatccacatcggcgattaaaacctgtgtttgattagaagccataatagcatccatcactctcaaggccatatctggagcaatttccctgatcccaatctgtttgagccagtcctcatagtcttgagatactataccatgacccgccaataatgcccaatttaaagtcgttgcaggcagcccttgaagatgacggaaatgagccaaagcatccagccaatgactaacagtatcatataacccttgttcttttgccccccaaattgcacccgccgaagaaaacagcacaaaatagtctaattgactacccaaagatagttgatgtaaattccaagaacccttaacttttgcctgaaaaactgcttcgagatcctgcaaagtacagtcttttaattgagcttgtcggcctgagattccggcaagatggaaaatgccacgcaggggataagcggtttcttcaatctgggtaaatatggcctgcatagcctcaaaattgccaacatctgccgaagtgactgcgattgatgctcctttttcctctaattttctgattttttgtgatatttgagctaattcggctgctgaatcccacaggaagcggactggtaatgagcggcgtgtcgttaaaatgagatgttttgctcctaaattgactaaatgttccgccaattctaagcctagatgtcctattcctcccgtaattaggtaggtagcctcaggttgaatcttaatggtttttgtctctagagacttcagaggaagcagacgagcaacatagccttgacctttgcggaagaccaaatgatcctcatcgtgagcatgagttaatcctaatagtaatgcggtaatattttgattaatgtcaacgtcgggatcaagatcgagcatacctccccataattgcggattttctagggcaataacacgccccattgcccaaagaggagactgaaacccgaaagaaggctgttctaattcaaagggttgggccccctgagtaacaaggaataattgagggggattagggattttttgaatagctttgagaagatttaaaagatagttacagcgattcaataaaatggattctggttgatctttgccatcactattcaaaagataaataatccgatctggagatggatttgacgcaaaccattcctctaattgttgtagttgattagcattcaaacaagactcagaagatgatatttgtgtatttttctccccttgataaattatccgacaggaatcacactttttcagtagttgctcttgaatccctaatgcaaaagtattttgctggggttcaacatcagtaaaaattagccagtttttagcggtgttagaggagatttctgaactttgagccagaataatactttgctgaaataaagcagtacctattttttgatcaggagaaacaaattccacctgagaaaaacccgatttaagcagcatagattcccaagtagatgctgtaattataggatgatttgggcgcaaatgataatcgctaaaacgccaccacccttgagtgacaccaaagattaaatcaatccaggaagattgctgagttaattctaacagtaataaatgaccgcctggacgtagtaaactttgaatatgaggcaaggtttcctcttgtaaattggcagtagagtgtaagacattagctgcgataatcaagtcataagaatgacagcaaaacccttgtaatttcgggtctttttcaatatcgagaactttgtattctagttcagaaaattcagccaaattatctctagctttctctagaaagaagggggaaacatcagtgaatgtgtaggtaatttgacgagagttacaagctttaagaacctgttgggttgtagctccagttcccgcaccaatttcgagaatgcggagggaggctgagggaggataacttgagagtagaagttcaacggttttagagatacccagattgagaatttttgccgaagatgtatttttataaaattcgctggctcctccttgtccatcttgagaaaataggatagataaaggagatatttttcccgtaataatggccgctaaatttgtggcaacttgtcgaaatagattgagttctatttgagcattaggataatgattgattaaatcttctaccgctaaatcaggattagattgttcaggttctttaacaattttccatcgggtattttgcttttctaaaatgccgactttcgctaatatttctagaacataattccagaaagatttatattcttgtttgagtccagcttgaataaaactttgatcgggatcaagaaaggtattcatttgaaagagttctaaatctttgagagctttaacaacaaagtcagccgccagtttttccatttcagaaaaagcgagagaaactcccatcaattctgaggattgtaattggggttctaagtaaacctctaaatccgttttaaggctggtcagattttctagcttaccgttagctaaatcacagggaagccaagctacttgataaagtaatttggcaaaatcaaagtcctctttttcttgataatacagtttaatcaactgttgaacaatggcggatattgttggtttttcatcttcagaataatgacctgtttctaagagggtttgcattaaagtagttttgtccttttcggataacattttgaccagattagattcccgtggaacagttgcagatggggtttttaaagaaatccagtgttgacgtttttgaaagggataagtaggtaaagcacatcgtctaggatgatagtcttgatcaaaactaaaccagtctatctttgcaccgcgaacatagagtttacccagactttctaataaaacttgccaatcagaaaatcccgagcgtaaactgggtagagttagaggttcagatgaagatagagatgattgaataattcctgagagaataggttgaggtccaatttcaataaaagtatcacatccaagagattgtaggaataaagctccttggtgaaattgtaccgtatttagtaaatgttgaagccaatactcaggagtcataatgctgtcatcagcaatttctcccgttaggttagagaccagagaaatttgaggttgactgaaagaaatctcttgaagaatcgttttaaattctgcaaccattggttctactaaaggggagtgaaaagcatgggcaactttaagttgacgaactttaaccccggcattagtaaaatggttacagagtttttgaattacgtttttttctccagaaataacggtatgctgttccgcgttaatggcagcaatagcgatttttattccctgactttggcaatgctcaacaactgagttcttatcgagaaaaatagccgccatttccccttgattttggggtaattgccccatcaagttgcctcgatggctgaccagttttaagccactttcaagatcaaaaacaccagcaaaacaagcagccgaatattcccctaaactatggcctaaaatagcggctggttgaattccccaagaatgccataattgagcgagagcaacttcaatcagaaatagtgcaggttgggtataagcggtttggtttaaggagtcatctgtatcggcaaatacgacgtttagtagggatttacccgttagtttttgatggtatttttcccctgcgtctaaagtttttctaaaggtgggttgagtctgataaagttgatgagccatccctacatattgagaaccttgccctgtaaataaaaaggcaatcttagacggtcttttttcatcaactataccataaatagttgactcataatcgagctgcttaaactgccgtaattgttcaataaaatcactatttttatagccagttaaggctaaacgatttgagaaatgaactcggcctgtatttgccgtaaatactacatcagacagatccttttcaggttgactttctaaaaagtctatgtagcgacttactaactctgttaaagctagttcggttcgagcggaaagggtgagcaaatgatagggacgttggctctgattgtcttgaggaataatgggaggagcttcttctagaataacatgggcattaaccccgccaatacctaaagagtttacccctgcccgtcggggtaatttttcggacttgtcttgcttagtagtccaagaaatagcttcattattaatataaaaaggagtctgagaaaaattaatttgagggttaggattttggaaatgtaatgtaggcggaataactctatatttgagggctaaagtcgctttaattaaaccagcaataccggaagcaatctgcatatgtccgatattggtttttactgaacctaaagcacattctccctcatttgcaccctgataaactttagctaaagcatcaacttcaatgggatctccaaggggggttcctgtgccatgagcttccacaaaactaattgtattagcatcaacaccggcaaaggctagggcttccgtagcggcagcaatttgaccctctccaccgggggcagtaaatcctaacttttgaccaccatcattattaatagcagagcctttaataactgcataaatatggtcatgatcggctaaagcatctgacaatcttttgagcataattactcctactccactgccaaaaatagtcccttttgcttcagcatcaaaggcgcgacaatggccatcaggagacataatcagtccttcttgatataaataaccaattttttgaggagaattaattgaagcagctccagctaaagccatatcactttctccactgatgagactctgacaagcgagatgaactacaactaatccagtagaacaagcggtttgaacattaacgctcggaccatgtaagttgagtttataagaaattcgcgttgttaaatagtctttgtcattagctaccattgtttgaaaccctcccattgaatctagtgtgaagggttgtaactcgtcattactatctaatttaccccgattaggataacaattatttatcagatatgtgttcatacttgcgcccgcaaatataccaattgatccttgataagtattaggattataaccggcgttttctaaacattcccaactacattcaagcagtaaacgttgctgaggatctagtaattctgcctctctatctgtatagccaaaaaattcgctgtcaaagtattcaacttgctcgagaattggtctagctctaacataattaggctgattaaatagttccgaagacactcccgattcttgtaattcttcttcagaaaagaaagagatagtttcgattccattttttaaattttcccagaaggttgttaaatttttagcccccgggaattgccccgtcataccaataattgcaatgtcatgggtttcattatggcgacggctccgattttcggcacgttgacggcttttttgtgctataacttgattagtatttgattcttcgcttaagaaacgggctagggtggcaacggtaggatttttaaacatttcagcaagggatagctgacggttaaaaagtttttcaagttcattttgaactcggattaagtgtatagaatgtccccctagttcaaagaagttatcttctaaaccaactgaggttaactgtaaaacttcactccaaactgctgctatttgacgttcattttctgattgaggtaaggtttgatttttctgacgctcttttgctaaatattgatctatttcttggatacgggtgctaaataatccctgttcaaaatccttttttaatttagatttttgaactttgccaatagaggttttaggaactaaatttctttctaagggaatgacataagctggagcaatcccgaatttttgggttacatgactgcgaatttttctaacaacttttattccctgttcaaattgctcagattctgggctaaaagtaataattaataaatcagtttctcgactttgatcaaagacggcaaaggcggctgtataagagactttaactccttctaattcttcgattgttgtttcaagttcatgggcaaagtaattaacaccattaattataatttcttgtttttctctcccagtaataaagagttcgcccttagataaataccccaaatctcccgtagtaaaccacccttcttgaaaaacttcctggttgagttcattattattataatatcctttagtaacagaattaccttgaatttgaagcctgccaatttctctttcaggtaaaggattattttcctgatcgactatccggatagttgctcccggaatcggctttcctagagagacaaaactattttcttcggtgagttcatttttacttaaaccggctgaccaagtaatcccagaacaggattcagtcatgccaaaggccggtttaatcgctctctcctgtagttgatgtttttcaagaatttctaagaataggcgaatcgtttttactgaaacttgctcgccagcattcactaaaaatttcattgaggagaggttataagagacgtgcttaagttcttcggcctgttgattaattaaggaaaatgcaaagttaggagaccaagaaatgcttacttgatgcttttgaatgagttctaaccattgcagaggttggcgtaggactaattccatgggaacatgaatttgatcacaagccaaatctaccgccataattcctaaaaatacgatagctcctacatgatccaagggcatccaattaagggtaacttcttgttgggtaaagtggttcatcaccactgtaccagcagtcatggacagaatattatgatgagttaatattactcccttcggcataccggtactacccgaagtaaagagtaataaggctgcatcttgtgggtcaagaatcggcaattgttcgattttagagggtgcttttctgagttcattaactgagataacttgccacccttctaaatgagagtaagttcctaatttttcaatttcagtaattagctcactgtcggataatatcaagggattgtctaaaattttccaaacattctctagttttttgacggcagaattttccagatcatagctaggagcaacggtcaaaggaactggaataattccccctaaaaaacaagcccatagtgcgggaataaagtcttgatttttggcaatttgtagaatgactttatgccctaattttattcctttttgttccagtccatttaaaataaccaaagcatcttgatataagtcttgataactctgaaaatattcagttgcgtcatttctgatataagtaattccatgattattatgtttagtggcagtttctaatacttctgacagagtccgccaattatcttccaattgtcctccaagactgatggaatgcttagacattttttttacacctctttatcaaaaataggaataatcttgaaaacctgatgaaccagtatatcgctacccacaagttaaaagtcagaagtgatcaactcaagtttgaattgtacctgatagaggtgcgatggtcaagggctttttgggtttgaaggctgatggcagtcggtcactagatctacctgagcttgtttgatgattaactgagaaaagttttgagcgatggtacttaaaggatcgatcgctttaatggagtcaattcctttgagtttgagagattttgttaagagatgaaattcggtacacccagaaatataggagcgagtgttatatttctctaataatgcttctatatccctaagaatacttaacggatcgtgtcctctttttagcactttatagatcatttcatgaatcaacttttgatcgctttctgagagagaaataatcagatctgcggtggtgcagccttcctgaaataattttttctggtaagtccctgtactagcaagtaaaagggtgggttcattatattcttggagttcttggtccgctattttaattaaggaaataagtttatccttcagattttcgggaatctgaggcagagcataatgagccgtacaacagccaatgactatgcaatcagccagtttattgagatgttccagattgacttggataaaatcaataaattctctttcttttccactatcaatagaacctgtgcgatcgggtgcagagggaaaagaaaaaacgatgacattaggggattcttgttccttatcaataaaaggattatattcataaatcgacttaagaaattcggcggtaaccactggtcccataccccctaaaacgccaagaatcggtagttttgtcttcattaaaatctcctgctcgtacaattgctgttgactaaaaattaaaatcttctgtgaacatatcctgcccctcttgaataagattttctgaggaagctaaggataagttgatcaaaggttcatgggcaaattttaaaacttgctctagccagtttttgaacaaatctatgagcaataaaattcgctcatggataaatatatctgtgttgtagattagcttgagataaagttcttcttcctcaacaaagataaattctaaatcaaatttagcggtaatcatttttgggtcaatggagttaactgtaattccgtccaaggccagatctacattttgattattttgcaggacaattgcaacatcaaagagagcattacggctaggatctcgttgtaaattcaaatcagatacaatctgatcaaagggatagtcttgatgatcataagcctctaaagtggttgtttttactttgctaaggacatccgtaaaactgtcgtgatctgttatctgatcccgcaggacgagagtgttaacataaaatccgatttgatcttctaaatcaggatgatttctgccagcgatagcagagcctattgtaatttcattttgctcagtataacggaatagaaaactcttaaccaaactaactaaacccataaataaactggcttcttgtgctttaactaacttctcaaaagtatcgatcaattcgggttcaggttgccatgtaattgtatttccctgaaaacttttaacaggtgggcgcggataatcaacaggtaagttaagacgaacaggaactggagttaatttagctaaccagtaatcccgttgactttgaagtttcaaggtctctaattgactttcttgccaagaagtatagtctttataatgaattctaagagggggcattaattgggaattttcttgtccataggcgtgataatgggtgagaaaatctttaattaaaacccctgctgaccaaccatcaaaaatgatatggtgcatattaaacaagacgatgtaattctcttgacttagtttaagtaagttaactttaagtaacggtcccacttctaaatcaaaagtcgttttggcattatggctgattgattcttcgatcaggttttcttgttctgtgctaacataagctgtcaggtctatttgtttaatgacaaagttcatttgattatggacaacttgacggggttgattattgattaaagtaaaggttgtccgcaaaatttcatggcgttgaattaactgttgaaaggcattttcaaaagcgtcaatattgagattgcccttgaattgataagcactgggcattccgtaagcattatgattttgatctaggaattctaaagcccaaagacgacgctgaccatgagacatcggataggatttttgggggggaattgccgaaatgggttcttgataattgtattgagtctgggagattaaagtagccaatccagcaatggttggaactttaaagaagtcagccaattttacggatacatttagttctttatgaacccgggttacaacccttgataagagtagagaatgaccgccaatttcaaagaagttatcaaaaataccgataggatgtttagagagaattttttcccagatactaacgagattggattctaaataattccggggtgcaacataattagaattcaccagagatttaccagtttctctgagttctctcagggagtgcaggtcaagtttcccatgtcgagttaaggggaattgctttaaaaaaataaagtaactcggaatcatataaactggtaaaaatttggcaagtaattctcgaatctcagcaatttctagagttttgtctgtttgacagtaagcagataattgagtttgattattaacttgaacgggtaaaacaatcgctctttcaatgggagcataacgagtcaattgatattcaatttctccggggtcaattcgataaccattgaccttaacttgattatcttttcgtcccataaactcaatgataccgggagcagtttgcttgcctaaatcgccggttctaaagagagtttttgtctcatcaagaaagctaggtttaaatttttcttgagtcatttcgggttggttatgataacccgatgctagggcggcaccttctacacaaatttcgccgattacatggaggggaacgggattattaaattcatcaagaacccctaagcgattgttatggaaaacttgaccgagggggatttcgctgtctaagttttccttgatttcatactgggatactcccacacaagtttctgtagatccgtaaacattgctaataatttctgctggaaaacgtttccgcaaagctaaggcagtttcccgatctaatttttcccctcctaccgagatatattttaagctggaaatggtttctcctggttcaagtagccccaagatttctcgatagatagatggggtggtgtgtagggcattaatttgattttcctgtaggaaagaaaccaaatgtcctatatattttatttcgtacatatatagggatgcacctatggttaaggggagaaaaatattacgaatagatggatcatgagtaacagcagctgtgaaaatatagcgccattcaggatgtttatctaaatcaaaggtaagtcgtaagctttgaataacattcaaaattgagatgtgacggcccatgactcctttaggattaccagttgaacctgaagtgtagaaaatataggcggtttggctagaattgcgaaatattttaggctcatctttgtcatatttttcaacaataggatcaattttatctaagcaaattttctccattttttcaggtaacttagagataaaattactctccgttaggcaaacatgacagccactatcttttaaaataaactcaatgcgactgtgaggatattgagagtctataggaacgtaagtcgctccagttttaaaggtagccagaatcccgatgattaagtagtgattacgctggagcatgaccccaatcacttttcctacacctagctgatattcctgctgtaaataatgggtaagacgattgactttttcatttaattcttgatagctaaggctaatttttcctgcaattaaggcgggagtattaggggttaatttaacttgagctataaagtcatcaatgatggtggctttctcagggagtttgcgagtttttccggttaattgtctgagtaacttctcttgttggactggggttaataaaggtaactgataaagaagatgattagcatcgtcaatgattcccctcagcaaaatttcaaagctttcaataaattgtttaattgtctcttttttaaagagttctgtattgtaattgcagtaaataatgaggttatcattaagttcaattaagttaaatcctagatcaaaaggtgtataaccaatcggtgacggtggcaaggatacttttaagtctttaaattcaggcagagttaaactaggatccatgttaaaagataccgaaatgagaggagaacgagaaaaatctctaggtaattgtaaagctgctaataaatcctctaaagtataactctgatggcgaaaagcgtcgatcagggtttgtttagtgtgttgtaaatgttcaataaaagaggtggtagcatcgacttgtatccgcaggggtaaaaattgagaacaaaagcctactaagttgtcactaccttctatttgtcgcccagaaataggaataccaatgactaaatccttatggccagaaattcgacgcaaaaaagcagtataagcggcgaacatcgtcataaataatgtagctttatttttgcgtcctactttctgcaaattttgcccaacttccgagggaatgacttgactttcttgtccgccagtgtaggttttaacggcgggacggggaaagtcggtggcaagctcaaaggttggcagctcttcctgataggttttcaaccaaaaatcccgatgctctaacatttgtggactttgcgtctcttgcgctcgcaaagttaaatattgccgaaactgcatcggtggtgtgagaacctctttagttgtgttattttgggatgaataaagttgaccaatttcctgcaaaattaatcctagtgaccaaccatctgccacaatatgatgagtttttaaagagagcagataatggtcagattttaagcgcattaaaatcacagcaaataaaggagcaatcgacaggtcaaagggtttttgggaaaactgagatcgtaacgctaaggccgtcgcttcgggattatcttcatccttaaaatcaatgaggtttaatttaatgttaacttcattgacaacttcctgtaattctccttgttctataattttggttcgcaaagcttcatggcgattaataacttgattaatcgttttttctaaaatgtaaacatctaaagaacctagtaattctagagatgttgtgacgttataggatgctgaagcattacggtctaattcagctaataaccaaagttgacgttgagcttcactggtgggaaaggactgatttaaagatggtagatgtcccctaccatcttcatcttcagagagaggctttttttcttctttcttgacttgagggcgtttagcattagcaaaaaaaccagcttgctgtaattccgtaatcgcttctttgacggctactataactctgtctatatcttcattagtatggcaggtggagagaaaacaaactcgtttttcccatgtgtagattcctttaagatttaataggtaataaaagaggggtaattcgatgggttgtaagaagatactataagctccaaaaggttcaaagcggaataaagagccaaaattaacaacccgaatcggaatgcctatttcttgaaaaaactgattaacttcggtggctaatcgatgagttaattgattcactttttcttgaatcgttggactgttttcccgaagatgtaaaagcacagcacgacaagcagcaagggctaaaggatgacgacaaaaagttcccccaaaagcggttaactcggtttggggatgagagtcatctccgtattgccagaaaccgccgtcaacggtatctaagaaatctgctttaccgcagatcatactaattggtaaacctcctccaatggccttaccataaatgactatatcagcttcaacattgaaccattcttgcgctcctcccggagcaatccgaaagccggtaataatttcatcaaaaatgagtgtgatcccttttttatgggttatttgtcgtagtttttgcagaaattcttgaggctgtaaatcgggtttgcgactttgaactggttcgactaatacggcagctaaatcatcagcatgagtagcaataatatcgaggctttcttcaactccataactcaagactattatgtcttcaaccattcctaaaggagtgcctaaacttaagggttgagtcgtggttttatcttctcctactcgtgctaagatgccgtcaaaagttccatggtaggagccggcaaacataacaattttttgacgttttgtccgggagcgagcaatgcgaacagccgccataatcgcctcggttcccgtattactaaaagcgactctttcgacccggcccatttcactaattaaagcggcggtttcggcggccagatttgactgcattcctaagcctattcctcgattcatttgttcttgaactgcttcaatgacaaaatcaggactatgcccaaaaaagttaaccccaaaccccatagctaagtcaatgtaattattgccatcaatgtccttaaaataagccccttgagcagattctgaaacaatgggatattgaaattcttttaaggccatgcggaagtcaatagtcggtttaacatccaccattgtcttacggctattttgtgaataggcttttgatttggcggttttctggttataaatactctgtaaattttgaataaaggcttgttgttgttcggttaaggatttgttctcagtcagctttaaagctaaggggtttaaattgggagaactaggtttctcaggagatttgggcttctcttgagaaaccggaaggtaagtttctgtcttagagctttgggtaggaatgatttgagtctgattcgttaatatttcgggggctatactgggggagacggtggcagtttgaagaacttctaattgcttgataatggttttctcatggaggtcttttaggtcttttaaagattgtaattgagccatcattaaggcttctttaccggagctttcaccaaagacagtgaacttaggaattgaaggaattgagaggggttcatctggcacacaagcaagaattaattcttggccattgttaatgggaatattgttttgtttagagaaactattcgccgtagcaaacccacaactttttaaaacggaacaccaattttcaccccttaataagggtgtatctgagcgtaattgttgatcctgaaagcgccaccatccgggggttaatccaaaggttaaattcagccatgagttattttctacggtttcgaggagaactaagtaaccaccggggcgcagcagttcccgaatatgggttagagtttctgtaatatttcgagtcgcatgaaggacgttagcggccacaacaatatgataattacgagcaggtatcccctgagaaatgggggacttttcaatgtctagttgatgaaagtttaggttatattttttctgaaatttttgcctagcttgatgcagtaagaagggagaagcttcgctaaaagaataagtgatatgatcgagatttaagtggttaagaattgcttctgaagtggcaccagttcctcctcctatttcgagaatttgataggggtgatcactattagaaaagttggttaaaatctggttaatagcttgggcgactcgttgattcatcaatcgagatacgggagaattgccatagatactttctgcatgagcaacggaaccttctgggaaaattaatgtcaaggggtctatatttcccttgagaacttctgctaaattttcgccgcagcgttgcaacatttctaattcaggttttgcagatggacaagttttttctagcttttgtagggcttggggtaaggaaaaagattcaggcaagtttttgacagtccaaatattcccttgattgtgaagaatattagcttcctctaaatcctgcaaataacgattgagcaaaatgtgatatttacgagcaacgggtaaggtttgtcttaggttttctatcgtccattgttccccctgattaagtttttttcctaaggactctaaggccttgatgatataggctgtagcgatgggttgcaattgctcaatgacttgcaaataattgcttaattctgtctcatcatcgataactttagttgttatttctgaagtattttctaagggtttttctttgacaaattggcagaggtattcggcgatatcaacaagagtttgtaaatcggtaaagagttgatctattttcactttgacttgaaatttttcttcgactttgcgagaaaagtcagtcaagataattgagtctgctcctaagtttagtaatgtctcatcctctggcagatcgttctcatcttctttcagaagtaaagccaaaattgattttaattgattacggatttcctgttgatgtttttgcatattgaaaactgtggtttcggtatcggtaaggttagaggtttgtgaatctaggaatattttgtcaatgctctgattttctgttcgaggattaggctgaaattggaaaggtttcctttgaaagggatagttcggcaatctgacttttttatagccataattctgattgaattgttctgggttgaaaggtgcgccattgaggtagagttgtgccaaggctgaaagaattgtctgccagttatctaagccacgattgagagaacttaaccaaatgacctcatctttataacgacgaccttgttctgctagtattggtcttggtcccacttctaaaaataggttatatcccttgttgaaagcggttattaaactcgacaaaaatcttactggttctcggcattgtttgctccagtaagtggcatctggtgcattttctaaaacctctccatcaagtcctgaaagtaagagaatttgggggcgttgataagaaatttgacgagcctctttttcaaattcttttaaaattggctccattaaaggggaatgaaaagcctgagtaacgggaagatattgagcgggaattttttgctttttgcaggtgctaataacttcctcaatgctggcactttctccagcaataacaatctgttgagggtgattaatggcagctattgaaactgtttgagtataatttttaattaggtaaattactgtctcttcatcagcaaaaattgaagccattttcccagaggtcgtggtttgcattaattgcccccgtttgacaactaaggcgagtccagcttctaagctaaatactcctgcgatacaagctgctacatattctcccacactatgaccaatcagtaaagtgggggtaattccccaagatttccatagcattgttagggaatattctagggcgaatatagccggttgagcgtaagcagtttgattgagtaaatcggtctgttcaccaaataatatttcagttaaaggatggtctaaatacttcgacaatatttcggcacattgatcaatatattgacgaaatgtcggctgagtttgatatagttgatgccccatgccgggataacaagccccttgccctgtaaaaagaaaaacaattttaggggatttttccgatgtaaaacgttgataaaaagtcaaatcatcaagcgggttttcttcagcaaaagcggctaatctttgttgcaattctggacaagtatcgccaacaatggctaaacgctcaggtaaatctatccttccgacagctgcactataacaaatatctccaatttcaggatgagattctaggagggtatgaaaacgtttagctaattcttttaaagcggttttgttgtgggctgaaagagttaagagatgactaggaatttgttgttgaatttctgagattttgcttacgggtgcttgttgaacaatgacatgggcatttgtgccggaaaacccgaaagaacttaccccagctatagggactttattgttattcggccaaggtatattttgagtaggaatttcaataggatggtcttgccaattaatcagaggattagggctttggaaatgaagatggggcgggatttcaccctgttgaagaatcagaattgttttgattattccagccatgccagccgcagcttcaagatgaccaatattggttttcactgaggcgacataaagggggtcggagcgctttccatacactgaggcaatggcattcaattcgatgggatctcctaaagaagtgcctgtgccatgagcttctatgtagctgacatcttcagggactattctggcatcagctagagcttgacggagcaattcttgctgggcgggtccactgggtacggttaaaccggcagcagccccattatgattcaccgccgaacctcgcaacagggcaagaatgtgatccccgtttttctgggcttctgataaagtttttaagattaaaaccccacagccttcccctcgcacatatccgttagcagaggcatcgaaggttttgcaacgcccatcgggggacatcattcccgactgagaaagactaatcgtaattgcgggttctaaaatgaggtttaccccacccactaaagcgagttcacattcacgatttctcaggctacgaatcccctgatggacggctactaatgaggatgcacaggctgtatcaatcgagagacaaggaccgtgaagattgagaaaataagagagccttccggcggcggcgcttagagcattgccactgccaaaaaaagagtcaatttgatcatagtttgtaccgtaaaccttcagggcatgatcaatgctagtaatccccacaaatacccctactttattatcggctaaatttttcagaggtaaattggcgttttctaacgcttcccaagcaacttctaagagtaacctttgttgaggatccatggaggctgcttcttttgctgaaatcgaaaagaaacgagcatcaaattctgtgatattctcttgaagaaatcccccataagcggtgttcatttttcctaaagttggtttttgagaatacagttttgagatatcccaacggcttttagggacttccactatagcatcaagcccagcttgacaaaaactccaatatttttctggggaattaatacctccaggaaaacgacaagccatcccaaccaccgcaatagattcactttgtctcgtttctaattcattgatacgagcctgcatgacctccattttgcttaaggtcgttgccattaattttttgtaatctatactctcaaccatgccctattctctataatttctaaatttatacgccgttaaacataaattaggatgctgtgctatcagtaaatataaacccaaatttaaccccagagagttaagcttactcatgttcatctacctatcctaccacatctcatggcttttgaaaaataatttttcaagtttaacctccatattgatcaagctccgttaatttttgattaagtaatcttgctagttcgtcttcactgaggctgtcgtagggattatgattgtcaggaattggatttattttaatctcaaaatcgagatgattggctagaatttcttcccttaaatagatacttaagctgagaagattaggataatcgaaaatgatcgaggatggcaatttacaccctaaatctctttctaagcgatttttaaattctataaccattagagagtttaaacctaagtctaggaatgatgttggttgaggaataaccttattttcatttaaccctgtcacttctcttaatattttctccagtccttctactaaagcggttattcgttcatctatagagacagactttaattgttctaatagttttgctggacttgtttgtttttgattgtttagggttaatacctcgctaaagaagggttgactaatgttgaaagtttgattaaaaatcgaccaatcaatatcgagaactatcccttgagtaatatcacctaaaattacctgactgagatattgaaacgcttgctcagagggcatcatctgcaaaccccaattagcgaaacgttgttgatcaatttggttgcccgtctcccaagctccccaattaatactaataccaggtaatcctaaactttgccgttgctgcattagagcatccatgaaagcattagctgcggcataattactttgaccaggcgaaccaaggataacagccgcagaagaaaagcttacgaaaaagtccaaagatagagagcgagtataacgatctaataataaagttcctgctacttttggactgattaccttttgatatttttgccaactttgattactgataagcccatcttctaagaccgctgctgcgtgaattattcctcgtaagacgggcaagtctgccccaaaacgagagaataaatttttcatatctgtgggggaagtaatatcagcttcaatcaaggttacttttgttcctttctccactaatggggctatcaattctgttgaagatttaacatggcgactacacaaaactaggtgacttgctcccatttctgataaccattgagccactaatccgcccagttttcctccccctccggtgattaaataagcccctgactgattaataaactgtcgtttttctgagataggaagagatgcagaaactaacctggctgcgtagcggtttccttgacgtaaagctaaacggaattcatgggggaaacactttaattcattgaataaaagttcagcttcattagcttctttatggattggtaaatctaaacaaacacaacccattttaggatactcttgattaatgactgctcctaatccccataaatgagactgttgaggagataaagccgtatcattgatcatcttattagccccgcgagtaatcagccataaatggggtaatttctcccagttattagtgagggtttgcactaaatttaagacagcatgagaactctgatctactgtatctagaacatcttcagcttctgaagattcccaacaaaaaacaacaccagtcggaaattctccagatggataagcttcttgatagagacgctgaaaatcagatttctgagccggattgatcacaaaaaaatcttgagaataacattgataattctgccccatttctacagtaattactttttctcctgcctttttgtataaattaattagggaatttaagtctgtttctggacgaaccaagactaaccaagaattttgaggatcgacggcaacagttggcatggaagaaagttttttccattccactttataaaagcaattatttgacttttcttgccataaactctgtaaaatagctggatttatgcgccgggctgttaagtcagtaaagcgagcgcaaagctgttcttgttcattataaatattaacatttactctcatttcaccattagtatctgagatgacctgaacttttgtccaaacttgcgaagttggatttaggaatatttccaaggaagagaatccataaggtagatgtaattcttgaccatgaatttcggggaaagctgccccaatactctgtaagcaagcatccaaaagaactggatgaaaataataacgccgatctgctaaactggggttaatactaattttagcttgagagccttttttgaaagaatataactcttgaatcgcttggaactgctccccatacctgatacccatctgctgataaagctcatagaattcacgaataaaaatcgattccttagggttttctctttctaatttagtttgggttaattctgaggcagccaagctttgtatatctttaggtttgacttcacctgtaacatgaagaacccattgttcttgtgcagaatcactgctaaatatctcaaaagtataaatcagttgagatgattttttaggtttaaaaattatttggattattgagggagttggagataagattaatccctgatggatatagacattttcaagggtgacaaaatgcccattaaatattttctgacttgcggctaaaatggcttcaataaaaccggtagctggaaatacaatgttttcaaataccttgtgttcttctaaataactagggttaagagaactcacctcaccttcaaagatcatgtctcccgttgctaactttttaaaatctctaatgaaaggatgtaactgagtcttgatttgccctagagaaaattccgaattagatagccaataccgttctctttgaaagggataagtcggtaaactaattcgcttaccttgtttaaatactttagtccactctacagaataaccattaacaaaaagtgtcgctaaacttctataaatttgtgcttgttcatcctgcccgggtacaatactaggcaaccataatagatcttggttagcggaaataaggcgagccatactcagtaatacaggcttagaaccgacttctagaaaacaacgataaccctgatcaattaaagacttaaatccttgactaaactgtacagtattacgcagatgagctacccaataatccggagttgtaatttctgaacctacagctttccccgtcagattactaataatggttaagttaggttcatgaaaagaaattgtttttaagacctgggaaaagtcatcaagaataggctgcattaagggagaatgaaaagcatgagataccgctaaacgtttagttttatacccttgatcaataaagtctttttccagttgctcaacaatctctttaaatccagaaatgacagtaattgagccattggctgaagcaatattaacttgattttcataagaagttagagcatttgctaccgtctcataatcagcataaatagcggacatactgccattgtggggcaattttcccattaatttaccccgttgagtcactaattttaaggcatcttctaaagaaaagactcctgcccaacaagccgccacatattccccgatactatgtcctaaaagggctgaaggttgtattccccaagattgccataatttggcgagtgcatattcaagggaaaaaatcaccggctgagtgatttgggtttcctctaataactggctattttgctcttgaaagattaaatctaggagagatttttctaaaaggggttctaaaatttgatcacaaagatctaatgtttccttaaaaacaacttctcggttataaagagtttctcccatgccagaatattgagagccttgtccagaaaagaggaaagatatctttggcggagtctctgataaaatcggtcggattaatgagtcagaatcttcaccatcttggtaatcaattaatgctcgttgtgccgtcgttattgagtctgctaaaatacagattcgttgcggaaaaatcccccgccctgtactggtggtaaaacaaacatcagctaaattgatagactcagtcaaaatatcttgatagcttctggctaactcttgcagggattgttcagaacgagccgaaaggggtaatagataaaaattattctccgaagcttgaggcaaatcagcatcaatttccccaacaatgatatgagcattcgttccactaaatccaaaggaacttactccagcaatccttggacgttcgctgatattccaaggttttccttgtacaggaacttcaaaaatatgagaactccaatcaaagcggggattaggatttttaaagtgaagatgaggaggtattttatggtgttgtaacgctagaacggttttaattaatccggcaattccggcagcaccttctaaatggcctaaattcgtttttactgaaccaataattaagggccgattaggggagcgttgaccaaaaacggcggacatactttctaattcaatcggatcaccaagggctgttccagtgccgtgagcttcgatataatcgatttgttcaggcttgagattagcgcgtttaagggcttgatgtaataatttttcttgagcttgaccattaggaacagttagcccactacttggaccatcatgattgactgctgtaccataaattttcgccaaaatttggtctccattcttaaccgcttggctcaacctcttcagaacaactattccacagccttctcctcgcaccatgccatttgcgctctcatcaaaggttttgcaatgtccatcaggggcaagcatatgggcgcgactttcgattaaagaaataatgggagttaaaataatattaacccctccagctaaagccagatcgcactcaccattaagtaaggcattataagctaaatgaatcgctactaatgaggaggaacaagcggtgtcaatagtcattgatggaccctgtaaaccaaggacataagaaagacgacccgccgccatactaacagaagttcctgaaccagtataagcattaatggcttgaggagaataacttaattgggcataatcttgagtcatgcaaccgataaaaactcccgtctgactgttgcgtaatttttggggattttgtccagcagattctaaagcttgccaggtggtttccaagagtaaacgctgctgaggatccatagcgacagattctctaggaataatgccaaaaaattctccatcaaattcctcaatttgttctagaaatgcaccgtaaggagcgtatattttgccggggacatcgggattaggatcataccatgtttcctgatcccagcgatcttgaggaatttctgttatggcatcttttccctgttccaaaagttcccagaaagattgtaaattcttagcaccgcctggaaatcgacaagccatgccgacaataacaataggatcatcatcgagttgtgatttttctacagaggatttttctggctgtttttgagaaatttctgcttttatttgaggggtcaatactggttgacaattatctagaacttcttgctgtaaataattagctaaggcttcaacattcggaaaacgaaaagtaattgtcgaagggagagaacaattaaagtcagtttgtaacagatttcgtaactctgtagaagtgagagagtccatccccaaatcaaaaaagccctgttgaggggaaaaagtttcatcatttgagcgtcctaaaacagtagaaacacgcatgatgatatgattagttagccaattaggacgctcttttaaggttaaattttgccattgttttaaaaactcagatgagggggcagcttgggtttttccttgaggcagaaagtttttataaaagctttgatgaatataaggaaattgttgccagtcaatcttaattacaccagcgcggataatctgatttagaagaattttttccagagcattaagggctaaatcgggtttcatagccccatatcctttagcggctaatctctccaaaacattgcgatctactgctgcacctatttcactccaaggaccccaatttatgaccgttccgggtaaatgatgcgtctgacgataatagataaaagcgtcttcaaaggcattagctgccgcagcattagcttgtcctgccgagccaattaaagatacagcagaagtataacagacaaagaattctaatgggtcatttagggtgagttgatgaagcaaccaagttcctttaactttaggatctaaaacataattaaatctctctggtgttagtcttaataaggttgtatcgtctaaggttccggcaatgtgaaaaataccctgtataggatattgagaacggcattcgtctaggacggcgtgcagtttttcagcatcggtaatatcaagttttttgagggtaacttttgccccactagaggagaaattggctaatatttcagggctaattccttctgcccctcgacggctacacaaaactagattccgcgcccctttttcaatcatccatcgggttgttgctaatcctaacccccctgtgcctcctgtgattaaataataggcatcaggactaaaattgatctttccatcttcaagttttctctgcaccaaacggggataaaaacgctgttccccccgcaaagcaatccggttttcttggggattactgtagatttcttgcagcagtttatcggctgcgtttacttcatctggatctaggtcaatcgccttaaaattaagttcaggatgttctaaaactaggctgaaggctattcctaataaggatgcttgagagggagagatcagggttttaatggcttttgctggtactgctccttgagtcactaaaatcagagtcgggggattttcttgctgcaataatgcttgtaagaaaaagagaaatcgttgacaattaatctcgacttgttgatcaatttctccagggattttttctaagccccagaagtacagtatttgacgagtttctgaagttatcgagtttctcaatattgataggtaatcttcagcaatctctgggttaatatcttgggtaaagacgcaagaacaacttattcctctctgttggaatagagggattaaaccgttagcaattccttgactatctgcccagattatttgatgagagtaagattttgctggcagagaaggtaattgctcactgcttctaccaataatgacactttgttttaataaatttcgggtttttgcttggcttggttcgataatattaatgtcttcaaattgattctcaatcagtaaattttgccaatcttttgtgctgattaacggataaccattccgccgcagatcttgactacataaccaccatccttctgtcaagccaaaggttaaatctacccaacgtcttgcccctgtactttctaagaggattagtagtcctttgggagcgatgagagagcgcacattttcaagggttttttgaaggttggctgtggcatgaagaacattagcggcaatgattatgtcaaaactgccagggagaaaatcttgaataaagggatttttttcaatgtctagagtttgatatttaataaagggatagtttctaaaattttccttggctcttgttaagaaactagaggaaatatcggtgaatatatattcgatatgttccgtgggtaagtgaggtaaaaggccagtagtaacggatcctgtgcctcctccaatttcgagaattcttaggggataatagggtggtaaattcgcaatagcacggctgattgtggtggcgactaactgattcatcaatttagatccggcggcttccgaataaattgatgcgatctcttctaaatccccttgaggaaagagtaattctaatggatcaacttgacgactcatgacttcggctaaagcagagccacaacgctccattagactaatttctgctggataatcggcaaattcttggcggagaattttaatttgtgattgggatgaaggtgcttctaattttttgaggaataaccagccatcttttgtctgattaacgattttttcttcagctaaaatgcttaaacatcgagacaataaaggtaggtaaaaatcgacaatttgaccttgatttgctatctgtgcctcggaataagtttgacctaattttggctgtccattaagttttgttaaggcttcccagatatagacaacgcttaacttttccaaggcttctattaagcgctcatattgcgccaatttttcccctagttgttgttctaactgtgcggggtgaatttgatttttaattacctggggagctactaaagtgtctctgccattccctaataattcctcgcaaggcatccattcttctagatagatttgaggggggatttcttgggggataatctcttgggattgaacggcttttagttctaagttggtgagggatgctaagggttgaccttggggggaatagatatcaatatcagcgataataatgttagggttaggggaggagttcttcagtcgaaccgcgctgattacctgctcatcaggagggtgaaaaaatgccaatttaccaagacgaacaggaacataagttactgaggattcttctttaaataaaatggcagcaatcccttgaaaacaagcgtctaacatagcaggatgaaaatgatatttttcccgctctaatctatcggttaatttgatttgagcaaaagctgtattttctccgcgcttcagttgatgaatgagccgaaagttactcccgtaatttatccctgatttttgataagtttcataaaaggagttgatatcgacttcttcaggacaattttttgcgatttcttctagatcacaattggttaaattagttgatttcaattcctcaattgttccagtaactaatacttcccaatttggctcaagtgcatggtaaattttaaagcttttttgctcaatgattaactgtaatgtgtcttccgtatcttttaaaattaatgccttcttaaattcaacattttctaaaataactctttgattctccccagcagctaaagccatttctatcaaggcagatgctggcaatatggcctgatcaaaaacctgatgttctcctaaaaatgcaggtttatgttgactaatgctccctcgatattgacggagagctaagggagaaggaaaatgatcgcctagtaagggatgtccagagtaataattagggtttttatagctagaagactctgatttattgccagaatttatccagtagcgtttgcggataaaaggcgaattaggtaaactaattttttgccctggatgtgagcgatggaaggcttcccagttaatattaaatcctctcacatagagttgacctagaaccctttgctcatgctgatcactgtgacaatctttccctaaactagataaccatagaattgaatttacccctaacttttgacgacctatattaatgagattggcactgattcccatttctaggaagatttgatatcccatttgatgcagagtagaaattccttgggcgatttcgtcggatttctgcctaatcttttcccctctattcaccaaatttctgagagattttttcacaacttcaccctgataaattagggtaatatcgggggagttagaatcgacttctggggtgcttgtgagcaaggataaaaggtcttctgagttggggttttgtgggctaattctggtgcgtttcgccaccagcttgacggtatcttcaagggaaaagacgcccgcttgttgagcggcgagatattcccctaatccagaacctaaaattgcagaaggagaaattccccacgatttccagagttcacaaagagcatactgataggcaaataatggcggttgtacagacaaagaaatctgaggctctaaggcttttttagatgacaataattcctgaagagaaaattctaaatattttttaaacagatgctcgcactgcctaaaagcctcatgaaatactggctcattattaagcaggttttcaatgatttctggactaatttcttcctcgtaattgcagagaaaagcaactttaggatggctttgcgcttctccataaatgatgtcgaagctattattttgaatattttgaaattgcttttcatccccattgctattgagaaaagcctgaattccttgatgcagattctcttgattagaaactaaaagagcgagacgatgtttatggggaaaacgaccagtatttaaagatagagcaatgtccttgacgttgagatatgttttctgctcaagctcatcgacaaattgagtcgtaaaaagacgtaaacgttcgggttctttagccgagaaagtaacgagaatgggtgatatttttgggttttggggttgcggttgaggtggttcgcttaaaataacatgagcgttggttcctgatgctccaaaagaactgactccagccgctttgagcttaccattattaacattccaaggacaattttgcgtaacgatactaatcggcaaggcatcccaattaatatgaggattgggttttttaaggtttagatgagccggaatttcacggtagtgtagcgataatgcggttttaattaatcctgaaattcccgccgccgccgccagatgacctaaattagttttgagagaaccgactaataaagggttagatttgcgacgattgacgcataatgcctcggctatggctttaatttcgatgggatctcccaaagatgttcctgtaccgtgagcttcaacataatcgatagcctcggcatctaaacgagcgtcagctagagcttctctgattaattcgctctgtacgggcccattaggaacggtaaagccgccactggctccatcgttgttgactgcggtccctcgaatcacggaccaaatgtgatcaccatcttcaagagcgtcactgagtctttttaagacgatgactccgcaaccttcgccgattccaaacccatcggcactttcgtcaaaggttttgcattggccatctggggccaacatctgattgcggcacaaggcgatgacgacttctggagttaaaactaagttcactcctccgactaaagcttgtctgcattcttgggaacgtaaggaacggcaagcgagatgaacagcgactaaggaggaagagcaagcggtatctactgccaaactcggaccattaagatttaaaaggtaagaaatacgcccagctgccgcgttagtatgattgcccgaaatatgataggctccgatggcattatagtcctcatttgaggtaagaatacgggcatagtcattgttagtaatcccgataaaaacccctgtttttccccttctagccgtcgttgttgccattcctgcattttccaaagcttcataggctacctctaaaagcaatctttgctgaggatccatagcgacggcttccttgggagcaattccgaaaaaatgggcatcaaactgggagacatcatcgagaaaccccccctgagaaacatagattttacccactttattccgatctgaatcataaaaatcctgctggttccagcgctccttaggtatttctctgaggtgatttttacccgctttgagaaaagaccagaaagattcaggtgtcgcaatattatcaccgaaacgacaacctaaacccacgatagctaagggttccctttgttgagactcgaaagcttttaatttttctttagcttcactaagagctttaaaaactctagtttggattgattggtcgttttcggataagttctttttatcttgaaagtccatagtgttagaatcgacttggaaaagaataattattgcgactgacggggtgacaagcagatggaaagtgaaacagggtgtagagtgtcgggtttagggaaaaagcttgagactttcgccaaaagataacgagggaatttggtttttgtctagtaagtcgattaatttgatggatcacagtgaggaaatttttcccccacctcacttaaacttcaacctcgttgtcaccccttcagctattacgaccagacagctaatcgtacctgatcaaggtagtaattgtcaatagacatctgcaataaacgtttatggggtgtggcatcctaagctctgctctcttggtctcgcgcaagcttatctttaaatgtcacactttctgcacttcttaatatttaattaatgatttttactaatttattgggttcagtggtttctacagtgaagattttttgtcaaaacatactagggaatgtaaaaatatgtaaaagtatatggagatgtgcagaatgtcggttagtatgctacaatgtcgaggctcagaacaattttggagaagcgacagaaaccctgaccttagccgtagtcgggtttcctgtagttcaaatagcaataattccactcgtcagagaccggaattatcgctttaagggaactgggaacggggaaaaaagcattgtaccccatgactctgaataccgccatcaaccactatttagggaaaaagttagaacagcaatggaagcacatctggtttcaatagattaccaaattcggcaacttcaagaaatagatccagtaactactctatttggtaatgtaagtcagaataaaaccggggagcagcatagcgttcttgaggtcatctctacagatttacaggaaaaaatcaacagtttaacggcaaataattctgttaataatttagcatttcatctggctgttgttcaggttttaatgtttaaatacactgctcaagtcgagtttgccacggctacagcagccttgaatacaaaaaaattagatagcctgatattttgccgattcaatcaacataattttagttcatttaaagatttactaagaatcattcgtaaagatttacaagaaggctatcgccatcaaaactatgcgctggatagtttggtcaaaaccttggcagcaagaggaggaaatctagagaatatttttgacgttgctgtgattaaagaaggactgtgtgcggacatttcttcgttaaatcggtttcaattagtttttaccatagaagcggatgatagtggtgtttctgtcacttttattaaagataaatttcctagggattttgtcgagagaatgctaggacattacctagaaatcttagaaatggtgacgagtaatcccgatatagatttgtcagaaattgatatattaacgaccgaagaacgagaacaattactgagagattggaatgatacggccattgaatatcctgaaaagcaatggattcatcagctatttgaagaacaagccaaactttaccctgagagaggggcggtcatttttgaaaatcaagaattaacttatcaagaattaaatgaaaaagccaatcaacttggtcattacctacaaaaattaggagtaaaaccagaggaattggtaggaatttatctagagcgttccttagaaatggtagtaggattattagctgttttgaaggctggaggagcttacgttcccttagatcctaattatcctcaagaacgcctaagttatctattagaagatactggggtaaaagttattattactggggaatcgctgcggggattgttggacgaataccgaggaattgttgttgctttggatacagattggtcagcaatttctcaagaaagtcagaacaattgtgacagtggtgtaactggggaaaatttagcttatgttatctacacttccggttccacaggtaaacctaagggcgtgatgaataatcataaggggattaggaatcgtttgttgtggatgcaggatacttatcagttaactaagagtgattgcattttacaaaaaaccccttttagtttcgatgtttcagtgtgggaattcttttggcctttattagcgggtgcaaccctagttgtagctgaaccagaaggtcataaagatagtacctatttaatacaattgatccaaaagcagcaaatcactacccttcattttgtcccctcaatgttgcgggtgtttctgcaagaaccagagctaaaaggatgtagttctctcaagcgggttttctgtagtggagaagctttgtcattagagttaacacaacgcttttttgagcattttgactgtgaacttcacaacctctatggtccgactgaggcggcgattgatgtgacttactggccttgtttgccggagagtcaaaaagccatagtcagtattggccgaccgattgctaatactcagatttatattcttaatccgcacttacaaccagttcctatagggattgtgggagaattacatattggtgggataggtttagctcgtggatatctcaatcgtcccgaattgacggccgagaaatttatccctaatccttttgctaaggtggaagcaggaatagggggagaaattagggcaaaattatataaaacgggagatttagcccggtatttacccgatggaaatattgagtttttagggcggattgaccatcaagttaagattcgaggtttccggattgagttgggggaaattgaagctatactcagtcaacatccagcagttgagcaagcggtagttattgcatcggagacagaaacagggagtcaaacactaattgcttatgttgtgggtcagtctcaagaaggggaactcttgacgacttcagaaaatgggcaattattcgatgaacaaatcgggcaatggcaaagcctctataatcaaatttacagccaaacatcggcagattctcagggtatatttaatattgttggctggaatagcagttacacgggggaacctatcccggctgcccagatgcgagaatggctagatgataaagttaaggttattctggctcaaaaaccgaaaaaagttctggaaataggttgtggaaccgggttaatattattccaagttgctccccattgccagtgttattggggaaccgatatctcatccgttgccttagaccatattcagcgaattaatcaagaagggccgaagctagagcaagtcaggctattgcatagcacagccgataaatttgagggtttggagtcagaaggattcgatacaattatccttaactcggttgtgcagtatttcccccatatagattacttactgcgggttttagagggagctatcaaggtactaactccgggggggtgtattttccttggagatgtgcgaaacttgcaactcatggaagcttttcacgctgatgtagaactttataaggctaaccctgaagattcgattaaggattttaaacagcgagtacagagaaaaattgagcaagaaaatgaattatttattgaccctgatttttttagagcaattcagtcctattttcctcagattactgaagtcgagattcatctagagagaggtcaacaccacaacgaattgactcaatttcgttacaatgttgttctacgaagcgcaacaattctggattttagcaccgactttccagaattaaactggactgaacagcagctgactttatctgaggtaagaaatcaactggggacatctgaggggttaagggtgataggtgtccctaattctcgcttgtttcgacctttaaaaagtgtggaattgttcagaaattctcaagactttgggacgaccgaggaatttcaagctattaaatcggaaattatcccagaaaatgccgtagaacctgaagatttttcggctttagctgaggatttatccctttcggtttgggtaacttggtcggatactccggaccgttacgatgtgatttttgctccgctggaaaattcccagagaaattacatcgcttttacccccacccacactgtaaaacctgaagggcaactttatgcaaatcaccctttaaggtctaagttaaatagtaaactgattccccaactgcggagttatctgcaaaagcaactcccagaatacatgatacctcatgcctttgtgcaattggattctattcctctgacaaataatggcaaaattgaccgtcgagctctaccctctccaagctataacagtttaaggaattcggagaattttgtagcaccttgtacccctcttgaggaaattttagcactgatttgggctgaagttttgggcatcgaagaggttggtattcacgataatttttttgaacttgggggggattcgattcgggcaatacaagtgatcgctaaggcgcgacaaatgggttttcatttttccttaccccaattattgcaacatcaaaccattcaagaattggccaattgcgttagctatgaaattgatactttagggactgaaaaaacggaagtttttagtttaatttctcaagaagttcgcctcaatttaccggaggaagtggaggatgcttatcctctaactgctctacaattggggatgatatttcatagtgaatatcaggggaatctatcggtgtaccatgatgtgtttacctatcatattcgtgctgattttagttttccagctttacatagtgctattcaggagattgtccagcggcatccagtattacgaaccagtttcgcactctttgaatatcaggaacccctacaattagttcatcgacaaatcgatgttcctttaggattagatgacctaacccatctatctacttctgaacaagacacggctattgatgattggattgagcgggaaaaaatccgcacttttgactggaatattcctcctttatttcgctttcatctccatcgccgcagtcaggataactttaacctgactttcagttttcatcactctattttagatggttggagtgtggcttcgttgctcacagaattgttacaacagtatctctatcttctcgacaaaaaagttctccctctctctccaactcccgctctcagttttagagattttgtcgccttagaaaagaaaactattcaatcgccagaatgccagaattattggcaagaaaaactcagagatgtgacgctgactaaacttcctcagtggtcgaaatctaatcaagttaatcaagattgggattggttagttcctatatctagtcaggtatctcagggattaaaacaactcggtaaacaagtgggagtacccctaaaaagtgttttattggcggctcattttcgggtattaagtttactgaataatcagagggatattgttacgggtttagtctctaatggacggttagaagcagccgatggtgaaaagatattaggtttatttttgaatactttgcccctacgtttagagttatctggaggcccttggagcgatttagttaagcaagcttttgatgttgaaagagaatgcttatcttggcgaagatatcccctcgctgagttacaaaaatcaggtcaacctttgtttgatacggcttttaattttattcatttccatgtttatcaaggtatcatcggggtgaaagatttagaagtcttaggagggaagttttttaatcaaactaattttacattgttagctaattttagtcttcatcccctttcatctcaaatagaacttacccttaaatatgatggtaattatctaggggaaaagcagatggagttaatcggaggatactacgagaaaactctcatcgctatggcaacggaagggttagaacgttatgaaacttgttgtttactttctgagcaagaacaacatcaattattgaaagaatggaatgatactgaggttcactatccggatgggtgtattcatcaattgtttgaggagcaagttaagcgcagtcctgatgcgatcgctattattacagaaaatgaacaattaacctaccgtcaattaaacgaaaaagcgaatcaattggggcgatatttggcgagaaaaggggtaaaatttgaatctttggtgggaatttgcctagaacggacccctgagatggttatagggttattagccattctcaaagcagggggagcttatgtacctttagatccagcttatccaactgaacgcctcaatgttatcttagaagatgctcaagtttccttgttgctaacacaagcaaaattagtagagaaattagggaattatccagggaatctggtgatattagaggcagaacaaaaaaatatagccctagaaagtcccgaaaacctctctttacccgtaagttccagtaataccgcttatgtgatttatacctccggttcaacggggaaaccaaaaggggttgtcattgagcatcacagcaccacaaccttactgaattggtccaaggaagtctttagcagtgaggaattagcgggggttttgggatctacttctatttgttttgatttgtcagtatttgaactatttttgcccttggctgtggggggtaagattattctggcccagaatgttctagatttgcctagtttaagtgcagccaaagaggtaacattaattaataccgtacctacagcgatcgcccaactactggaaattgaggcgatacctgagactgtgcgaacggtaaacctcgccggagaagctttgtctaatcaattagtccagaagctttaccagcaggaaaacattaagaatgtttataatctctacggtccttcggaagataccacttattccacttttagcttagtgcctaaaggacaccatggacaaccgagtatcggccggcctattgccaatactcaagtttatattctggactcttttaagcaaccggttcctctaggaactattggtgatttatatatcgggggtgaagggttagctcgatgttatctgaatcaacctgaattaaccgccgagaaatttatctccaatccctttagcaatgaacccaatgctaaactctataaaacaggagatttagcccgatatttacccgatggaaatattgattttttggggcggggtgataatcaggtaaaattgcggggtttccgcattgaattaggagaaattgaggcaactctagggacttatcccccagttaagcaagcggtggtgaaggtttgggaagactcctatcggaataagagattagtcgcttatctagtggcagaaaatgacccgataaatactgaggatttgcgtcgtttcttgggacagaaattgccagagtatatgattccggctctttttgtctccttagaagctctcccgctgactcctaatggaaaaattgaccgttccagattacccatccctgagataccttccacatctgagcaggattttgttcctcctcatactcagaaagaaaagattttggccagtatttggcaagatattctcagcattaaacaagtgagtcgttatgaccgcttttttgaagttgggggcgattctattatcagtattcaggttgtcgctcgcgctcgtcaagccgggttgaagattacccctaaacagatatttgaatatcctactcttgcggaactggctacagttgccgattattccacagcggaattagctaaacagggtttagtgacgggtattgtgcctcttactcccattcaactgtggttttttgagcaaaatcgcgctgaaatgcaccactttaatcagtctgtcctcttagaagttccccatcatctgaaagctgatttgttagctcaatctctgagaaaattaattgaacatcatgacgctttgcggttacggtttactgtggaggaaggacaatggcaacaagtcaatggaggaatgccggatgaagtaccttttgaagtgattgatttgtcttcgattcctcaatctcagcaaggggaaactctcttagcaatggcaacaactcaacaagcaagtttaaatctctctagtggactattaatcaaggcggtgctatttgaattggcaccctatcaacccagtcggttactgattattattcatcacttgggggttgatggtgtatcttggcgaattttgttagaagatttattgatgacttatcaacagctagaaaggggggagaatgtagaacttccacctaaaaccatagcctttcaggattgggcgcttctcttgagggattatagttcggctccgctcaccaatcatggacaaggggagaaagcgagagagccattagactattggttaactcaaccttggttagaggcaagcaatttacctgtagatgacgagactggaaaaccatacaatacagtagcgacggccaatgatgtcacggtgactctagatgaagagcaaacccgcgccctcttgcaaaaagtccccgctgcctataacactcaaattaatgaggttttgttaaccgctttagcggaaactttgacacaatggacagaaaatttgaccatatcccttgatttagaaggacacggacgagaagatttgttcagtgaggttgacctatcgaggacggtgggttggtttaccagtctttttccggttattttgcgactcccccccgaaaatcaccccggtgagcggctcaaatctattaaagaacagttacgagctattccccacaggggaattggctatggaatttcgcgatatttgagtgatgatgctgatattaagtctcaattagctgaaattcctgccagagaagttttgtttaattatttaggtcaatttgagcaaggacgattgcaaaaaggggagtggaaattagcggatgagtctaaggggcctaatcacagtcttaagggacatcgtagtcatttattagagattacggccagagttatcgagggacagttacaagtaaactggacttatagccatctcatctatgaacgttcgacggtagaatatttagggcgcagctataaagaagctttgctgaaattgattgagcattgtttatctcctgatgctgggggttacactccctcggattttccagtagcgcacttgaatcaacaggaattagacgatattctggcagaaattgactaataaggagaatctttcatggcagacacaaaaaatcaacccgccaaaaatgtggagtctatttatcctctttcccccatgcaggaagggatgctctttcatagtctttatactcctgattcaggtatttattgtagtcaaactctaattactctggagggagaaattaaccttacagtttttaggcaagcgtgggaaaaagttgtagagcgtcactcggtattaaggactctatttctttgggaaaaacgggaaaaacctctgcaaattgtgcgaaaaaaggttgatttgccctgggattatcaggattggcgcaatctttcccccacagaacaacaacagcgtttagatttattgttacaaacagagcgtcaacaagggtttgaattcaaagttgctcctttaatgcgctgcttgatgattcaactatcagaccaaacttataaattcctctgcaatcatcatcatattattctggatggttggagtatgcctattatttatcaagaagttttagggttttatgaggcaggtattcaagggaaaagtcatcatcttccttcaccgcgtccttatcaagattatattgtttggttacaggagcaaaacccatctgttgctgagagttattggcagcgaactcttgaagggtttatgactcccacccccctgagggtggacagactccagttaatgaaatctgaaggtaagccgacttataaagagtataactgtcatttatcggcttctctctccaaagacctgcaatctttggcgcaaaagcataatctgaccttatctactctagtacaggccgcttgggcgattcttctcagtcgctatagtggggaatcagaagttttatttggggttacggtttctggtcgcccccatgatttatcaggggtagaacgtagggtaggattatttattaatacattgccgctgcgagtctccatcagagaatcagatttattgctatcttggttacaggaattacagcaaaagcaagcagaaattcaggattatgcttatgtttctctggctgaaatacagagattaagtgatattccaccgggggttcccctgtttgagagtttggtcgtttttgagaattatcctagggaagcgttatcgcgagattctcgtcaatccttaagggttaaggatgtggagaattttgaggaaactaattatcctttaacggtggttgctattcctagacaagagttactgattcagttaatctatgatactagccgttttactcaggatacgattgaacggatggcaggacatttacagactattttaacaggaattgttactgatcctcggcaacgggtaacacaattacctatattgacaacccaagagcaacatcagttattagtagagtggaacaatagggaggctgattatcctttagataagtctttacatcaattatttgaagaacaagctgcacagaatccgcagggaatagcggttatttttgaagaccaaaaattaacctatcaacagttaaataaccggggcaatcagttagctcactgtttacgagataagggtgtaggtccagaaagtttggtcgggatttttatggagcgctccctagagatggtcatcggtttattagggatattaaaagccgggggagcttatgtacctttagatccggattatcccaccgagcgcttgggggatatcctctcagattcgggggtttctttggtgttaactcaggaatctttaggggattttcttccccaaactggtgccgaatcactgtgtttagatagggattgggaaaagatagctacctatagcccagaaaatcacttcaatctaacgactcctgagaatttagcctatgttatttatacatcaggttcaacgggaaaacccaaaggggtattaattagccatcgggggttaatgaatttaatttgttggcatcaagacgcttttgaaattacgcctttagacaaaattactcaactagcaagaatcgcttttgacgctgcggtttgggagttatggccctgtttaacagcaggtgcgagtcttgtcttagttaaacctgaaatcatgcaatctcccccagacttgcgagactggttaattgcccaagaaatcaccgtcagctttttaccaactcccctagttgagaagattttatctttagaatgggatgaaaatatagcccttagaattatcttaacgggtggggataaactccatcattacccttcaggattaatgccttttaagcttattaataattatggacccacagagaattcagtagtaactacttcaggattagttcgcgattatgaggaaggaaaccccccatccccgtctattggtaagccagtttataacacaaaaatttatattttagatcagaatttacaaccgcttccgattggggttcctggagagttacatattagcagtgtggggttagcgcggggttatctcaatcgtctggaattaactcaagaaaaatttatttctaacccttttaattcgggtatattatataaaactggggatttagttcgctatcttccagagggcaatattgaatttttagggcgcattgataatcaggttaagctgaggggattacggattgaattaggggaaatagaagcagttttagagacacattctgaagtggaaaaagccgtagttattttgcgagaagatacctcagacaatcaacggttagtcgcttatatagtcaggaaatccccctcattaggtatcggagaattgcgccgtttcttacagcagcaactgcccgcttatatggtgccttctgcctttgtcatcttgtcggattttcccttaaataacaatggcaagatagacaggaaaaaattacccgtccctgatgagacatcaattattgaatctgcttatatagctccaagaaatgaaaaagaaagcctcttagctcagatttggcaagatgttcttcaggtatccaaaataggggttagtgacaacttctttgagttaggaggacatagcttaaaagctatttctctagtgagtaaaattcaggaaaagttagggcaatctttgcctattaaacaagtatttgctcatcctaccattgctgaacaagcagtattattaagcactgttacccctctgacggtagccactattccccttgtatctacacaagaaacctacgaaacatcccatgctcagagacgtttctatgtcctgcaacagatggatcttaataatgtagcttatcatattgtttccaccctcaaaatagcaggagattttagtccagatgtctttgaaaaagccatacaattattgatttcccgtcatgaatccctgcggacatctttcattttaattaacggtgaaccacaacagaaaatcctgcaaaatcgtccttttgattgggaatttaaagactggacaaataaacctgatgaagaaatcctagaaacgattgcaaaagagagaaaagcgtttgacttagagaaaagtcccctggtgcgctctaagatttataaactatctccgaatgaatatattttagagttagaaattcatcacattatttgtgatggttggtcaatgagtttgttagctaaagaatgcttacaatactactctgatttagccaaaggattacagcctaatatagagccattgccgatacaatataaagattatgcagggtggcaaaataatcttttaagaagcgaaaataattcaaaaaccctagattactggcgggaaaaattggacaatggacaactgaccagagttcacttaccaacagactttaaacgtccccaaataaagacctttaaggggtcccatttaagctggaaatttacccaagaaaccatttctaaattaagaaaaagttgtcaagaaaacgaaataaccctattcatggcattggtagcagctgtcaaaatattactgtatcgctacagtggtcaacatgatattactattggtacagaaatcgccaccagaaaccatcctcaactgcaatctctaatcggtttatttctcaataccttagttattcgtgaccaaattgaacccgaaaaaggctacaaaaatctactcgcaaaggttcgtcaaaccgttaccgaagccttagaacattccgattatccctttgatattttagtagagaaattagctgtttctagagaaattaaccgcactcccttgtttgatacattagtccttctgcaaaattttgagcaatctgtaggcttagaaaatatacaaataaaatctctagattccctcaccccgaccagtaaatttgatctatcttttgtgtttagtgaagatgaggaaaaactcagattagagctaatttataacaccgacttattccaagaggagaggatgaaaaaatgtctcattcacttcgataaactcttgaatgaaatgctatctaaccccgcccaacccgtcaaagacatttctttgttatcggaggcagaaaccgctttcattgccaattttatcaatcctattcctcgcttagaaactcgcacggttatccatgattttattgaccaagttgaagccacaccggagaaaacatcgataatttatcccgggggtaaatttagctatcaagaattacatgaactaactaacttttgggcttatgccttaaaagaattaggcgtggaaaaagataaggtttgtggtgttctcctagaaggagattatcgtcagttaatcgctatgctggcagtatttaaagcgggaggaatctatttacctctacgtttagatgaacccgaggagcgccggcaacgcatgatgattaaaactagccccgaaattatcttagttgcggctgagaatttagaggggattaaaccccaactatccgcattagaaaaaccgcctcatatcttagtggttaaggctcataaaattcagcaatatcatcagtggaatggcatggattatcaagagtttccttgccaattaagcaaactgcaaccccttctagctatgccggatgctgatgattctaattatattatgtttacttctggctcaaccggtgaacctaaagcaattttaggcagtcacggcagcttacgtcatttcattgattgggaaaaacgggaatttggcattaatgaaagttggcgctgtttacaaattgctcaaattaattttgatgcttatttgagggaaacctgtgtgactttatgctcagggggaactctgtatattccagagagtacagagcgagaagacttagagcttttattactgcgaataggagaatgggacatcaatttactacacactgtcccctcggtaatgcgtctgtttttaaagatagggcgtggtttagttaatgcacataatctcctgaaaagtttgcgaatttttgtcttaggaggagagcctttatttgtgaaagaactggctgaatggcatcaaatttttagctctcagacagaatttgttaatatttatggggcaagtgaaactacatttgttaagcatttttatcgaattcctaaccctaataatattccctatgaacgggttccgggtggtcaaactttgccagatgccgcttatgcagtggttgatggaaatcgcgccagggcaataggagaagtaggagaagtgttcgttaaatccccctatttaaccaaaggttattatcaagatgaaagcttaactcattcagtttttgtgcctaatcctttgaatggggggagggatatagtttatcgtactggagacttaggcagactgcttcctgatctaactttagaagtaataggacgcagtgacaaccaaattaaattaaatggggtacggattgaattaggagagattgaagatgtcctcagtgggattgagggagtagaaaaagccttagttatggctaataaaaaggaggaattagtaaccgtaattgcttattatcaagcagaggatacagttcatcaggaatatattcgaggtaaattaaagcaactcttaccgatttatatgcagcctagctttttaatgcggttagaagcttttcccttgttacctaatggaaaaattcatcgtctagctttgccaaaacccgaagaaaatattactaactcaactaaccaagtcccagattttaatccacaagaagctttattagcttccctttggggtgagttattagaagcagaagttagtaacagtaatcagtcattttttgaactaggaggaaacagtctgaaggcgatgcgcttagtgtcacaaatccgtaatcaatttggagtttctctccgattacgggaaatttttacccataatactttaaaagaacaagctgtattaattcaatcccgacaaaaacgatgatcaacttaccacaatctgactcaattaacccactggaaaaacaaaaatattaccaagtctctcacggtcaaagaaggctttggattttgcagcatatcagcgaatcttctagtgcttataatattaggcttgccatgagaattaatggcaagttagatgtttctatattaacagcagcctttcaagaactggtgaaccgtcatgaaattctcagaaccacttttaccagtgttggtggcaatattaagcaagttattcatgaggaaatacccacagaacagttaatcatttttaaagatttaagagcagaaaaagatgctgaactcttggcagatgatttaattcaagagtcggcaaatttaccttttagtttagaaaagttgccccttattcgggtcttattggtgcagattaattcagaagaatttatctttggtttgactgtccatcatattattggggatgcacaatcacttgatattatctttcaagagttctttacattatactctgcttatactcaacaaaaaaaagctgaattaccccctcttgctctacagtataaagattatgcggcctggcaaaatcagtggttagaaagtgaagaagttagagaacaacatgagtattggtgtgaggttttttccgaacatccccctatcttaaacttaccgatagacttccctcgacctcaagtaaaatcttctcaagcggcttctcacacttatcaatttagtcagagtcttagccaacaattacaaacctttgccactcaaaataatacgaccctatttattaccctactgaccttctttaaaatattactctaccgccacaccggccagcgtgatttagtagtcggtatccctatttcagcacgaaatcatcctgatttagaaaaccaaatcgggttttatgttaacaccttggctttgagatctttattaccagagggagtaacttttaagcaagtcttaggggaagtaactaacacctgtcttgatgcttatgaatatcgtgattatccttttgataaattagtatccgctctcaatttagaacgtgatttgtccagaaatcccttatttgatgtcatgttttctctactgagtaaagaaagcaaaactgtcttaaaaattcctggtttggaacatcaaccttatcccttaaaaccacggatggctcaatttgatatgacttggagcttctttgaagatagtcataatcttacattagtgatcgaatatgagccagatttatttttgcctgaaaccatcgccagaatgaacggtcactttttacaaattattaaaagtgtaattcagaatcccgatggtaaattatctgagattaatttattaacccctgaagaacagcatcaattactaatagagtggaatcaaaccgaagtcgcttattctcaacagtgtctgcaccatttatttgaagaaaaagttagagataattccgaggcaatagctcttatttttgagggcaaaaaattgacctatcgagagttaaatggtcgagctaatcaagtcggtcactatttacaagaaaaaggcgtaacttcagaagtattagtggggatttttattgagcgttcttttgagatgatcatcggaatattgggaattatgaaagctgggggagcttatgttcctttggatcctaattatccccctgagcgcttggattatatgatatctgattcggctatctctctgttgttaactcaacaatctttagtccaatttctgccagaaaatcaagccgaaatactgtgtttagatacagattggtcaaggatagctaattatagtcaagagaatttgacctctccagttaaaacagaaaatttagcttatgttatatacacttcgggttcaacgggaaaacctaaaggtgtgatgaatattcatcaaggaatttgcaatactctaaaatacaatattgacaattataatcttaactctgaagatcgcattctccaaattactccctttagttttgatgtttcagtttgggaagttttctcatctttaacatctggtgctaccctagtcgtgacgaaacccgacgggtataaagatatagattatttaatagatttaattgtgcaagaacaagtaacttgtttcacttgtgttccctcaatattgcgagtttttctgcaacatcccaagagcaaagattgtcactgtttaaaacgagtaattgtcgggggagaagccttatcttatgaactcaatcaacgattttttcagcaattaaactgtgaattatataacgcttatggaccaacagaagtagcggttgatgctactgtctggtgctgtcagcccaattcccagttaatttctattgggcgccccattgctaatgtccaagtttatattctcgatagttatctccaaccggttcctattggtgttgctggagaattacatattggtggaatgggtttagcgcgtggatacctcaaccaagctgaattaacggctgaaaaatttattcctcatccttttgctgaggggaaattatataaaacgggggatttagctcgctatcttcctgatggaaatattgaatatttagggcggattgataatcaagttaagctgagaggtttccgcattgaattaggagaaattcagacagttttagaaactcatcccaacgttgaacaaactgttgtgattatgcgggaagataccttatataatcaacggttagttgcttatgtaatgagaaaagaacccttattaacttctcaggatctgcgccgtttcttgcagcagaaattacccgtttatatgatcccttctgcctttgtgatgttgtcggattttcccttaaatcctaatggtaaaatagactttcataaattgcctataccggatgagacttctttagttgaatcaccctatttagcaccccgcaatcaaacggaaactatcttagtaagcctttggcaacagcttctacaagctggcaagataggggttaatgataacttctttgagttggggggtcattccttacaagctatgaatcttatggctttaatttatgaaaaaatcgccatagaaattcctttatcaatgatttatgaaaagccaacagtagccgaattaagcgattatattatctatgctcaagagatgaatattcaaccgaaagaacgtccttatgtggtgtttaataaggagcaagaaaaggccgtctttttatttccacccgcccttggtttcgctgctgcttatgccaatttagcggagtatataacggattatgctctctatacttttcgctacattagcgatgaattaatgttagaaaaatacgctgaattaattgaggatttagctcaggatcaagatataaaattaatgggacattccgctggcggatttttagcgatgttaatggctcaacaattagaaagtcgagggagagttgtttctgatgtcattttactggatacttacagaggaggacgtgaggctaaaaaagctgatatgtcagagattcaagaaggggttgatgctttcttattaaatcccaaacgtcaggaattaagaggttactttttagggaatcaaaaactccgcgaccgcacttatcatcaagtgtgggaatactttaattttctttggaattctgatttaaaaaatgtacaaattcaagggactattcatttgattcgtgctgagggaaactatgaagctcgagatgattggacacaagcaacaaaaggggaaagaatcaatcattatgccactggtattcatcgtgaaatgattgatcctccttatcttcccaaaaacgctctgattatcaatagtattctcaacccaaaacagtcgtaaccgtttaggtggcggacgaaatctggcaatctgagagacatagatgagcagtacctagggtctgctgaaaaagttttttcagtaaaccctaattaataccaattatctgtcgaccggaaaattgaggcatcggggaacatagttggattaccactagcgtcgattttttgccgtaattctcgcagttgtttattcccgatgagaaaatcactttctactaattgatagggcagtacattattatctaaagcatacactgccgtgatgccagcagctaccccagaggaccactcgaaggaatggacacgataggcggccgcggcaatatgactgagagcgatacttttacccgctatcagtaaattatcgattttttggggaattatagcccttaaaggtatctcaaaaggataagcttggccctgtccctgtctttctcctgctttttctgtattacccggtttttcggggggatgttccgtcatgcagggatgaaaatcaatcgcatagtgaccgataccgacggaatcggggtaaatagtcgagcgcttgcgtttaacggccttgtcgggggataatgtgccatcaagtacggaaaatccctctaatcctgccaaggtggcaattaagcgccgatattctgctggcgaaagattttgacgatagaaatcgctttgaaaattttgtcgggaaatatcgatttctgtgacggtaaaaccagcggggaaagtcagggaaggacgaccgataatccgtcttgcttcccgaatatagggatattttgacaaaccgtgagcagttcccatgggagaatcaaaaccggacagataacggttattcaaatggggaacttttaccccgtctcctaactgggaatcggtggttccttctactagccaataatagtaggaaatggcgtgttcttcgccccttgcgagggtttcggtgcgtaatcctcccatccatcccccgggagataactgtcctaactcttgcaactgttcacgggtgtagataaagttatccttggcagtccccggacgataatcatttccccaggtccaattctgcatggagatatcccccgggacgggttcggtaaaagtaattcccccaaaggttttctctttacccagttgtggactccaaatacgacgataggtgaaaaccaggtcaaaatcggctaatcgcggcagttcatagctaaaatagggggcatagcgttcgtaataaacgggtttctcgtgggtttggggtttttctgtttcctccatggcgaaggtataggtaaagccttgggtacagtaggggtctccagtgacgctagaggaagaaggttcgagataactgcgcttatcgacacctaaacggtagggaatatctgataatccgattatttccccggtttcggtcgcttcaatcacataccaatctgctaattgattcggttgggaggatttggggacaaaacggaggattttcttatcaaaacggggagaattttcgtagcgatagatatccgccattttttgcgataaaaactcggtatttaggggaggagtaccttttgcgggactatgttgaatagcaattacactggtaatctgttgaccggtgccgcgattgggtaaagtttcaatatttaattccttgactaccgtggagggaaaccatttcagggttcctttaccttttttggcagcgtcttctaactgttgaaataataatttatgtccgtcaaaagggaaaaaacaagacccacttacccaacattccccggggttttgtttgccgtaatgctttctaattctttccctaaattctagataacctttcgggaaaaataatttttctctttgtgtgcgtctttcatctaatgcggaggttccctgagaagatatctgtccccccacccagtcggtaatctcggttaaacagacggtttttcctaataataaagcttcgtaggctgcaccagcaccggctaaaccaccacccaccaccagaatatcacagccgacgctttgatctggttctcgcgggggggacgctagggtaaggggagtgaaagcttgtaggagaaataatcccagagagagggatttaagaggagtaaagtgatgattgaaaattttaggggacattattgacaaatatcaatgttatggctgagagtttcttctttctttgaagaagtagctagagcatctgttcctgaaatcctgatgttttttttgggggatattgagaactttgtagcttgatactggcttttaagagattatacacctccaagctgacaatcgatcgcttttctggaaatgtcttgacaaaatagagatagcctgattcggtgtcattccctttgttattccctgtaatccttcctaggttaaatgcaaaacaaacctgggtaagacatcttccccagataaagtagcaggtaaattaataatttccacatcgctatttagtcggtagatttccacctgctgctgttgaggattaatcaaccaacccaaacgtaaaccactggctaaatattcgcgcatcttttcgcgtaaagaggttaaggaatcggtacgagaacgtaattcaatcacaaaatcgggacataaaggtgggaacttttctcgctcttctgcgctcaaagcttcccatctctcccgttttatccaagcaacatcaggagaacgatatcctccatttggtaaacgaaaaattgtcgaagaactaaacacctcaccaagttgagtttgctcgttccataccccaactttaacaatcaaattagcttcttgtttaccagtatttccacccacgggaggcataattaataattctcctttttgattacgttctaaattccatgtttgattagcctgacagagatgataaaattgttcatcggtcagattaactgtctctagatttaacactacagttttcataatcgcttctcctttttgctactttatatcattgattcatatcaacctatttacctaattgactctctaaaaattctcgccaatcgggattagtagtgtctagggaaattagatagggttgttccttttcattaaaaggttctgttttctcaatttgggcatttaacacctcgatagtagcgtcagaaatatcgccttttctagcggcaatccgttgttttaaaacttctataggtgcgtgacaatggacgatatgaaaaggaatctttaaattttgggcataggttaataagggttctcgccaagcatatttatcgtagcgtgcatcgagaataactggataacctaaagttattaaaattcgggctaattccgctagtctagcgaaggttttttgactcatttcgagactatatatatctagacttcctgtttgatttaagtcaattccagccaaatgtttgcgaactgcatcggaacgaatctgaatagcattaagatttttagcaattactttccctatggtactcttacccgatgcagaaaatcccgacatcagaattaatctcggtttctgcggttgtgtgtactgccaagctaattgataataatcctgtgcatctgctttaattttctcagaaaaagtgtcaccatcaagcagaaaactattgacttttgccctcacatacgcttgtctagtcaggtagagaggcaagacttttaaaccctcccagtcagcggtttgttctaaataagtattgacaaataaattagcgaaatcttctctccccctagcggttaaatccatggctgtaaaagcaagatcatacatgacatcaacgaagcgaaaagattcattaaattctatgcgatcaaataattgtatttctccctgccactgacagatattatttaaatgtaggtctccatgacattcgcgaatcatcccttttatttgtctttcctctaaccaatctcggtgttctgcgaaaaatttatctgtataagcttttgtttcatcgtattgtttttgggtttggacaaaattaatatatttctcggtttgttggtagttttcatcaaaagcttgtttaacaatttccaaattgccaaactgagtaatataggaattactcacagcttgccgatgaaattgtgccactttttcagccaaagactcgatcgctttttccgttagttctccccgttcaaaaattttactgagtaaacattcttggggaaactgattcatttttaaaatatattctatcacttttccttctccatttaaacttatgctaccctgttcttcattaattgacaaaacttccagatagatattggcggcaacttttttatttaactctagttcctgttctagataatattttctcttttctaaagtggagaaattcaaaaaatcataattaactggtttcttgactttataggcataatctcctgtcaagaagataattgaagcatgggtttggataatttcaacgggaattttgacagaatgaggataaaagtcgggattttttaattcttcgattaatcggttgctatccatagggagaactcctcggtggtacatctcatttttgtaaatttactaagttgagatttttggctcttcgttactctttatgctaaatcaacagacaagatgccaagataacatacttctaacccaaaaattccgaaagtttctaaagccatagcctctccgttttattagtttaagtttattgttgattccctcgaccatcccattcgttgtccttcgctcgaaataactaattatttctccaaaccagtttcggattgtttgacaactcttagtaaaaacactggaggattttgccaaccattccgagatggatagcattccctctgtcggattctctgaggtttcataaatctttctaaattcttcctttaattcctgcatctttttcaaatttgggaaattttctttgatagcgtctagtttgattttttgggtttccgttaaatctttttcattttttaacaagctatatttacttcgctttaaaacttctagcttcgcttctttttccgctttctgttttttatttctctgcgcttctacggctcttttttctgcttttctttgttcgtctaactcttgattaatttgtttcattacatggaatctatcggcgactacctcggccgatggcatcaattcttttaccaaatttttatagggcaaccaaaggtctatgctgacttcttcaatttgctctaacacctcttttccccaccctgtaagcgtttccctcaattcttcttgtgttcgcttctctagaatagctattagttttcccgtatctaaatttactaaaactgcacagtaatttttttgtcctttgactagagcgatttcgtcaattcctagtctttttaatttcgataggtctgtctctgtaatttcttcagctatgtcctctatcattctttgaatctcttcttccgttacgtcatttcttcggctaatatttaaaatatctccttcttttaattgttcgagtatattctcggctagtcttttcgtataggttcgtttcttggcgacaaaatctaactcttcgctaaagggttttcgacaattatcgcacttaaattgacgacgattaacttgtaggtacactggttgacctgagattggtaaatctttgactaaatgtcgatgattttggtggagtttatcgctctctaacccacaacgaggacagattgctttttgatttttcgattcgattcggcaaactataccgatattttctaggtgtcgatagccttgaatacaggttccttgtaggttcaaaaatttgtcaagtatcataagtaaaatactctggtttttggctattatatcaaatcttaactcaattgtctatcttttggcattaacctgtttgtgccttaagtccttttctgtatggatttcagctacttttgagcttaggtactctcattgaattttattttaagttaattatttgcataacaattcccgaagagcctgttttcttcaacttccacctcttggcggattctgctttcgtacagtttcctctgcacgttgagcaacttcttcacggcttaaaaggattgcttgcatatactaactcctgattacgatttgacttctggagacctctctataatatctcatactaaatccgggtaatagataatcagttttcaataaccggatttagtataaagctcttctgggactctggcaaaagtcttacagtctctaaactctagctctcttatggggtaaaccttcaagctatcgctaactaacagaaacccgaaatttgagtttttattagaaaaaaagttagcgatcacttgtcaaccaagggtttcagaatctggattcggtcaggaatttccgaaagtcccagaagagcgttatagcagttctcacacctgtgtggcacaagttaacctttgctaattaagctttccaacatcgataatgtacctcttgcgaacaggaaacgctataaattgctgcgttacgctttggctaacgcacctacgatttatgtttctgtttgtggctaaattgacaaaagttgctcaaaatatagccttagcaaaataaatcggcctattcctaggtaagctgagttgaggataagccgaaaccctaattttaccgcagctggttagctctattcttcgtggaagtcatgaccaaatcttcttagtcctaactaaagtcagctaatgcgactaacccccaatttcaaaatcaaattcaggttcgggaggagattcaatttctaaatctttagcgtccggcaggggagcatcattgacaatagaatcttgttcagcctcaacctcactcggcgaatcactttctggttgacaagaggaaatactaatatagtaattgttctggtcgccttcaataatatcaccttcttgagcgatattatcagcttcaatcttgatgtcatcgatattaatattatctccatctttggtaacattatcggcatcaatgttaacaatatcaccctcatcagtgatattatcagcttccatctgattaatatcgcctttggcagcataattatcaggactgtcttgagccttatcaacgacaaaatcttcgactagatcgaaacctaaaccgaaaccgaatttatttttgtttgacatagttgatactctcctagagaattaatgaaatcaagaaatgattaaaggggtctgtatttgtccaagccaagtgcataatccactaagtttttatcttgatgagttgcatcaggagccagagccttttttagcaaagttttaatgtttgccaataattcatcttcaaaatcaatccaaaaaagtctccgattttcatcaataaaagatgactgaagtaaccctgtaaaacgtcctgataactgcattgaacgagaggtaataccggggttatcttgtcctaaaactaggtcgtaattttctcgccgttcgggttgtggaaagatgtttccttgacgatcttgataatttcggacaaccataggagaaggggggatatggggaagacgatctcgcataagttcggttagggttggaatccccggtgaaagacttagcaaggtctggtaaacgtgcttgttttgctcccatcttttgttatctttaggaatagtgggagcaacttctactaaaccaataccatattcgcgtaaatagtcacctgagtcaccaattttaccaacaggaaggcggtgagtttcatcaagaataactagagttttaagacgatccttgccattttttgttttgggatttgaccctaattctaacacataattgagaaaattgtcaaggaaaataggcccaatgattttagaagaagattgggatagaggttggcttaaaatgaccaatgttttgtgataaagaatatcatcaaagctgagttttttgaggttaggatgaggttctgtataggtaagtaagtcttcttgatctaacagatcctgaaaaattttaacccctcgccgagtcatgactaattctttatgatccatgtagaaaaaattagcaaggcgcagttgttgttctattttttctaggaggttagttttctcctgtaattcctcctttttttcgggggttaggttttgactattaagatcaagattgattttatttttaccatttttta

SEQ ID NO: 72 - DNA, 57817 bp, Anabaena sp. 90
agaaccggaagtaatagcagaaccaacagtggaagcaaaaccaataccagcactagaaccaatacaaaaatcagtttaaggtgttttaggaagttggaattttagacaatattgatggggtatttatctggaatacccctttttaatacacgatagtatagaattaaaaaaagatggattggttagagttcattgccacaaaaggtattaatctacccagaacttacaaagactttttgaagataatggggcatggggcaggtaagtttttacgtggttcagattgcttttatcagcatttgccacaaattcaagaatgggctaaacagcttttagtagaaaatgattttcctcaaactttaccggaggatgcttttgtatttttcatgcaccagggatatcagttcagctttttcaaactttcagaaggtgataacccaccaacttattcatattgtgaaggacaagaagagccttattttgttaaaagtcatgatcagtttagtgactttctatttgtggaaatcaatctttatttaaagtctttgatgctgatagcgaattagatatagcaattcccatgcaagtgaggtacaagaagtcagaattaaacgcagataaacgcagatagacacagataattttgtacctcattagactagaaaacgctatatttctcacactgaattgaaaatcatgcccatttttaataaacgatagtatagaattagcaaaataacctttaatggagatttaacttgtcggcatcttcggtattatcggttttgtaaaactatttctacagcacttcccggtgttatgaggtacatatctagcgggcaagacttgtactgagcaagcgatgccctgagcctgtcgaagggtcgaagtatgcccgcactacaagagtttcatgattcaactttgtacctcataagagcggaaaccgctgtatttaattacctaaacttatgaaattactccaaaaatgtttgttcggtttaatgctgattccttcgggaatattattgaattccaggacaattaatgcctcacaggtagcaaatcagtggtattttggtttatgggattgtaatattgatggtcgtaatgccaaaatgcagtggcttgtagttgatgaccctcaaactagttgtaatggtgatgtttgtagcacaacatcaggtgttaaggttgtaggacggttcagtgataatggtagtgcatgggttccgctcgcaaaacgttctgcaaattccacatctctctcaattcgtcatcccgtcaggcggaatgtgggttataaactattttttttatttcgataatctttgacagtcagaagttgccaactagagttttgtgaaagttccagaacccattgatgataatcaaatagactttctctatgtccaacactaataaatgttgttttcgtctcttgtaactgttgatataaattctcttcattcttcaaatccaaagcgctggtcgcttcgtctaagatagtaaagctaggatgagtcactaataggcgtgcaaaagccaggcgttgttgttctcctagtgataatatgttttcccaaggcagctcagtatcaaaactatcaattcgactgagcaagttttgcaggttcactttttgcaatagttctttgagttctgcatcggtcatctgacgatttctattaggataaagcaactgttcgcgcaaagttcctaaaataatgtaaggacgttggggtaaaaacaacaggtcttttagagaaggtcgcactaaacggccagttcctgcattccacaaaccggcgatcgcgcgcaatagtgaacttttaccgcgaccactagggccgacaatcaataaaccttctcccggttgaacagacaatgataagtcttcaacgattacctgctcatagttaggcgtttgtaaggtaacatcctcaaaagccagacgattttcttctatggttttaatagtgctgacattctcaggttgtttggtaacaacttctaaagcatccgagaaataagctaaacgctcaacataactggaaaatcttccagaagttccaaattcatcaattaatgttgccagaccattagcaaacatactgcaagctataactgcttggttaacttgtccaaaatcaatttcacctcgaatataggcaggtgcaaatattaaaaacggaaacaattggattacagatcgatatcctctattaaaaatgtctttatttttttcccaattaattttactttcagaatttttcaagagagtattaaatctgcgctcaattatatttaattcttggctttctccttggaaaaaagctatagattcagcatgattccgaacatgagttaggctgtagttgtagcttgctttagattcaagttcctcttgcgtaatcttatctaattcttgactcatataagcagcaatcagattacctataatagtataagtaagtagaattgctactactagtttggaaattgaccaaagaattattaaaaaagttgtcatttccaggactttttccaacaaagtagcagaaaaatttagagcagtcctggcaataggttcgatttcttgagatagacgttggtctgggttatcgatatcggagctaaaattgattttataataggcacgattgctaaaataattttctaaaatctgcttgttgagccattgataccaatcaagggcaattttttttctgacaaatttagaaaatcctgttaagagggtgattaagagcagcccaaaggcgtaaagtgctaacgtcttaacaaatttagaaatatctttatcttgaacaataacatcgactaaatagcgatcaacaaagctattaaaggcagttatgcccacaagcccaattattaataaaatgaggagaacaagcattccccatgcctgaatcacatctgaaaatgctcttacacctggctctgttggaaaccagtaaggggcggcgatcgcttttacagccacccaaaactgagtaaaattagcaaggaaagcagtattttttgaagcttgattataaataacttgattttgcatattatacatcttgcaaaaataatattttactattataaattattatgaaactttgttttatatttcataaggtatagctatcaaataagaaaaatacattattaatattgatatttatggctcttgcgtttgttttatggtggttgaggattgattatcacaaaacccttacggggttacgggacaagggttataaactataatgcccatattttgaatgaaatgccgacacaataaggttttcaaggattctgaactaggttctccataaaaagtaccgaagaacctaaaaaattatgaattccaaactttaggattgatgatgtaaggtggcttctcgccctgaagcacttgcaatatttggttagctgcggaaagtgcagcagccataccagcttcaggtgtaactccagctagatgaggtgagaaaattacattgtcaaactcatataaaggattattaatagctggaggttctggctcaaacacatcgattgcagctcctgctattaatttttcgcgtatagctgtaactaaatctggttggcgaactacttttccacgagatgtattgattagaaaagcagaaggcttcattttcttaaaagcttctagatcgaacatttcacaagtctcatcagttagctcaggatgcaaagatacaaagtcagattcagtaagtaggtagtctaaatcttgtactaaagttgctctgacggtgtctgctttaccgcttggaacataaggatcgtatgctaaaactcgcatctgcaatgctgtactacaaattttcgcaacagcactaccaatccttcccaaaccaacaataccaagagtttttccttctaattgaatgggttgtacctgattacgaattaagtagtttcctgctttgacacattgattgagaaaagttagttttttagcaagtgctaaaatcatggaaagtgtgtgttctgtcacagccgttgttgacaagccaggattattaactaccacaattccccgttttgttgcagcagcaatatcaattgcatcagttccaaatccagaagtactaataacttttaaattttttgccaatccaattgcttgggcatctaatttagtaggataacggacaaatacgccagatacatcttgaatagcttcatggatttgatgctgctttggttctttgataatctcgacattagtgtattctgcgagcagtttttcacctatctcatcatacattttaccaattaaaagaactttatgatttttagtcttgcttgggaaatttttgggggggtaaataattgtcatgttaattaaccttaatttgtttgatacaaagatgctttagactcaagattttatgaatgaaattgctgagataatttcattgtttttgtcagcaaaagagaattagatgaggatgaatctaataactgaaaaaaggtttcagctatagtagttaaagggtcaattgcttgaatagaatcaattctattaagcttgagatgtttggcgagaatatgaaattctgtacaaccagaaataaaggaacgagtattgtatttatctaacagtttttgaacatcttcaagaattattagggggttttgtcctcgttttaatactttaaaaatcatctcatgaatcaagtgataatctttttcatctggagaaataatcatatttgcagcagtacaaccttgctcaaacaattttttcttgtaagtacctgaacctgcaagtaaaagtgcaggttcatcatgtgcttgtagttgttgatcagcaattttaattaaagagattactttattagtctgatgctctggtagatgagccaaagcataatgagcagtacaacaaccaatcactatgcggtctactaattgattcagtttttctaaatgtatttgcacaaaatcaatgaattctctttcatttccgctatgcactgaagtcgtgcgatctggtgcagcaggaagtgagaaaacgataacgttgggtgcttcttgttcgttgtctatatactggttgtattcataaatagttttgagaaattcaatagtaactacaggccccattccgcctaaaattcccagcacgggtagttttttattcatagtttttctccaaatttgcaattctttatttgtataaattactaaaaattaaaatttgtggcgaaaagactgttatcttcttgacaggctttatctgtgtgatcgcacagatgtaataatggtgtgtcaggagatttgactacttcttctagaagagtttctaacaactttatcatcaatgaaatacgttcgttagcgaatatatctgtgttgtagattaacttcaaatataattccgcttcgtccacaaaaatgaactctagatcaaatttagcagtaacaagttcctgctcaagggtattaacagcaattccatctattgctaggtctacattttgattattttgcagaacaactacaacatcaaataaagggttacggctaggatcgcgtttaaaatttaaatctgatactagtttatcaaaaggatattcttggttatcatatgcctctattgtggttgttttcacttttgccagtaaagtagcaaagctatcgtctactgttatttgatcgcgcaagactaaagtattaacataaaaacctatttgttcttctaaatcgggatgatttcttccagcaatgggagagcctactgtaatttcattctgctcggtatagcgaaacagaaaacctttgactaatgttagtaagcccataaataaactagcttcttgagtcttagttaataactcaaaatccttgatgaattcttgatttggcttccagataaccacagaaccagaaaaactttgtacggctggtcgagtataatctaaaggtaaatcaagcggtgctggagcaggaatcagtttaggtaaccagtaatccctttgtgcttgcaattttggtgtttggagttgctgattttgccatgaagtatagtctttataatgaattcttagaggtgggggtaattctacattctcttttccataggcatgataatgtgcaagaaaatctttaattaaaacgcctgctgaccaaccatctgaaatgatatggtgcatattgaataggactatattactctgttgactcagctttagtacattaatcttgagtagaagaccggattctaaatcaaaagtagttttggcattgttacgaatagcttcagcaatttttgctgcttggttttcatcatctactaagtctatttgattgactgcaaaatctacctgttcgtttactatttgacgaggttcgttattgattaaagtaaacgtagtgcgtaaaatttcatggcgttctatcaattttttaaaagcattttcaaaggcagcgatatttaaatcaccattgaattgataagcacttggcattccgtaagcataatggttatgatcgaggaattctaaagcccagagacggcgttgtccatgagacatgggataagattcttgttgagttattgctggtatgggttcttgatagttagattgagctttagatattaaagctgctaatccaagaattgtgggaactttgaagaaatcagctaatttaactaatacatttaattctttatggacgtgagtgactactctagaaaggagcagagagtgtccgccgatttcaaaaaagttatcaaaaattccaatgggatgtttagtgagaattttttcccaaatatggactagctttgattctaaagtattacgcggtgcagtataagagacttgtgttaattgatctgttggcttgagagcgatgagcgatcgcaagtcaaatttgccatgtttagttaagggaaattgctttaagaagataaaggaactaggaatcatgtaaactggcaaatatttagctaaaaattctctgatttcagaaaattttatatctttatcagtttgacaataagcagataattgaatttggttatttacctctataggtaagacaattgctttctcaatctcggcatagcggctaatttggtattcaatttctcctggatctacacgatagccattgaccttaacttgattatcttttcgccctataaattcaatcacacctggagcaatttgtttacctaaatctcccgttctaaagagaattttttctgaatttaaaaagttgggttgaaatttttctctggtaatttcaggaagattacgataaccaactgctaatgctgcaccttctacgcaaatttcaccgattacgtgcagaggtacggggtgattgaattcatctaagacaaataatcgattgttatggaaaacctgaccaagaggtacgtctgtatttaagttgtcgtctattgtatattgagatactcctacacaagtttctgtagaaccgtagacattgctgacaatttcagcagggaagcgttttcgtaaagcgatcgcagtttctcggtctaatttttctcccccgcaagagatatattttaaagtggggatagtttcttcgggtgcgagtacagctaaaatttctcggtaaatagatggtgttgtgtgcagtacattgattttgttttcttgtaaaaatgaaactaaatgccctatatgctgtacttcgtacatatataaagcagcacctatggttaaaggtaggaaaatattacgaaaagatgggtcatgggtgacaggtgcagtgaaaatataacgccattcaggatgtttatttaagttaaatgtcagtcgtaaactccgaattacattcaaaatagaaatgtgacgacccatgactcctttagggtttccggtagagccagaagtgtataaaatataagcaatttggttagtgtctggttggaaattaggctcatttatgtcaaaatccgtcaaaatattgtcgattttatctaagcagattgcttcgatttcttggggtaattgggagataaaattactctcggtaagacagagatgacagccactatcttttaaaataaaatcgatgcgactgctaggatattgggggtctatcggcacatatatcgccccggttttaaaagtagccagaatggcgataattaagttttgattgcgtccgattgcgagtgcgatcgccttccccgcaccaaggttatatttctcacgtaagtaattggttaaacgatttaccttctcattcaattctcgataggtaagagtcttttcctcaactattaatgcaggtgcatcgggtgtagatttaacttgagcaataaagtcatcaatgattgtagaattttggggtaattctattgttgaacctgttaattttgccaataattcttcctgttgcacttgtgttaataaatgcaactcagacagtaaaatattggcatctttaattacaccctgcatcaaaatttcaaaactttctagaaactgtttgatagtttccggcttaaacagttctgtattgtagttgcagtagataatcagtgcgtcattgacttcgatgaaattaaagcccaaatcgaaaggagtgtaaccaattggctctggtggtagcgatacgttcagtccttcaaattcaggtaaagttaatttagggtcgagattgaaagagactgaaatcaggggagaacgcgaaaaatctcgttgtaattgtaaggctgctaataattcttctaaggcgtgagtttggtgtttaaaagcggctatgagtgtttctttggtgtgacgaagatgtgtaacaaaagaagcagtgacatctgtctggatacgaatcggtaaaaattgcgaacaaaagccaactaatttttcgcttccttcgacttgtcgtccagaaatgggaataccaattactaaatcatcatgaccggaaatgcgccgcaaaaaagctgtgtaagcagcaaacattgtcataaataatgttgcttgatttttgcgtcctacagtctgtaaattttgccatagttgaggagcaataattttactttctctaccgcctgtgtaagttttgacagcaggacgaggaaagtctgtaggaagttcaaatatggggatttctccctcataagtttttaaccaaaaatcacgatgtgcttgcatttgtggactttgcgcttcttgctgtcgcaaagctaaatatttgcgaaactgcattggtggcgataaagattctgtagcaacaccaatttttgctgaataaagtttgccgagttcattcaaaattagccctagtgaccaaccatctgcaacaatatgatgagtttttaaagttagcagataatgttcaggtgctaaacgcatcagcacagccgcaaataaaggagcaacacccaagtcaaaaggcttttgcgataactcagttctcaatactaaagcagttgcttctgggttatcttcatccatcaaattgattaacggtaagtcaattgtgacactactgattacttcctgtagttcgccttgttctaatattttggttcgcaacgcttcgtggcgattgactacttcattaatcgcttgttgtaaagatgaaatatctaaagcaccacgcaattctaaggaagtagtcacattatatgatgctgaagcggttgtatctaattctgccaatagccaaagctgacgttgcgcttcactggtaggaaattgctgatttaaattattcctagcatcttcatcttcagtgcgatcgcttgcttctcttttctttgtttgtggtggtttagcatttgcgaaaaaacctgcttgtcgcagttctataatcgcttctttgacagcagctactactttatttatatcctcattggtatggcgagttgagagaaaacaaactcgtttttcccatgtatacacacctttgagatttaataagtagtaaaaaagtggtaattcgataggtttgaggaaaatactataagcaccagaagattcaaagcgaaacaaagagccaaaatgaacaatgcggataggaattcctgtttcttgaaagaactgattaacctcaatagctaatcgattagttaattgattgactgtttcttgaagcgttgcgccttgttcacgtaaatgtaaaagcactgcccgacaagcagccaaagctaagggatgacgacagaaagtaccaccataagcagttaattctgtttgcggatgggaatcatctccataactccagaaaccgccatcaactgtgtctaagaaatctgctttaccgcagatcatactgataggcaaaccaccaccgatcgccttaccataaactactatatctgcctcaatctcaaaccattcctgcgctcctcctggagtaatgcgaaatccagtaataatctcatcaaaaattagggcaatttctttttgttgagtcaatttacgtaatttttggataaattctttaggctgtaaatctggtttacggctctgcacaggttctactaaaactgctgctaaattatcagcttgctctgcaattatttctagactttcttccgctccataggtaagaactataacatcttcaaccattcctgatggtgtaccaagactcaatggttcagctgttcctgcttcctcgccagcgcgggctaaaatgccatcaaaagtaccgtgataagaaccagcaaaaatcacaattttttggcgttttgtccgagaacgagcaatacgaactgctgccataatcgcttctgtaccagtattactaaaagcgactcgttctacacctgttatttcacaaattaaagcagctgtttctgctgcaatattagactgcattcctaaaccaattccgtgttgcatttgttgctgaatttctgtcaacacaaaatcaggactatgcccaaaaaagttaactccaaaccccattgctaagtcgatgtaatcattgccatcgatatcacgaaaatatgcaccttgggctgattctgaaacgatgggatactgaaattcttttaaagccatacggaagtcaatagtaggtttcacatcaaccattgtcttccggctgttttgcgaatatgccttggattttgctgttctttgattataaacaatctctaatttttggatgaaagcttgctgttgttcggttaaagatttactctctgtcagttttaaagctagtggattcaaatttggagaactaattttttgggtaggaggtgtggtttctgttttgcttattttaggagtaggcgcagtttctgtttgaatcaacaaaacttctggtgtattgcttggtgcaacaggtgcagattgcagtatttctaattgcttgataatagttttttcatgaatatctttgagttctttcaaagattgcaattgagccatcatcaaagcttctttgccagaggttggtattgatacagctactgtttttgattggtgatcaatagcactctcaggagaagtggaagcaataattaactcttgtccattgtagatgctgatattattttgttgagaataaatatctgcattgacaaatccacaacgttttaaagcagcacaccaactttctccacttagcaatggagtatctaaacgtaactctttatcttgaaaacgccaccatccaggtgtgagtccaaaagttaaatcaagccatgaattattttctactgtttctagtaataccaagtaaccaccaggtattagtagttctcgaatattattgagtgtttctgtaatatttcgggtactatgaagcacgttagcagcaacaactatgtgataggaatgcgctgttaacccttgagaaactggtgatttttcaatatctaattgattgaagttaaacttatgcctatttttaaatttttgccgtgctttattgaggagaacaggagaaagttcagtgaaaaaataagttgtatgattgagatttaaattattaacaattgcttcagatgtcgcacctgtaccacctcccacttcaataatttggtaagggcgatcgctactagaaaaattatttaaaatagagttaattgcttgggatactcgttgattcatcaaacgagatacaggagaattgccatatatactttctgcatggacaactgaacctgctgggaaaattaactctaaaggatctatatttcctttgagaacttctgctaaattttctccacaacgttgtagcatatccaattcaggttttgctgctggacaaattgtttgcagattctctatagcttctggtaaagaaaaaggcgtaggtaggctttttactatccatacattaccttgattttgaataattccagtttgctctaaagtttttaaataacgattaactaaaatatgatattttgaggctatgggtaaggtttgtaataaatcctctgttgtccaggtgtctgctatacttagtcttttacctaatacttctaaagctttcaagatataagcaacagcaattggttgtaattgggaaatcacccacagataattatttaattctgactcggaattagatacttgaactgaggttttagttaaaatatcatttattgctgtttcatcagatgtatttgatggtttttgtttaatataatcagatagataaatagatatttcgtcaattgtttgtaaatcagtaaataattgatctatcttgacttttacgccaaatttttcttcaattttgcgaacaaagtcggtcaaaataatcgaatctgctcccagatttaataatgtctcatcatctctaatgtcattttcatcttctttaagtagcaaagccaagatagactttaatttattaccgatttcttgctgattttttttgatatttgcaacttttgctaaattcatattagtctccattagctctctttctaaaggcacttctttggtcaaacttgattgtgataaaacagtagatttaaattgaaaacgttttctttgaaaaggataatttggtaattggatatttctatagccataatctttattgaatttttcggcgttaaaattaactccattaatgtagagttgggcaagtgctgatagcatcgtctgccagttatccaagcctctattgagagaactaagccatatagcgtcatcgttataacgacggccttgttctgctagtattggtcttggacccacttctaaaaataggttatatcctttgtttaacgccgtaattagactctggaaatactgcactgcttgacggctttgttgtctccagtaacttgcatcaggcgcagttgttaaaggttgtccatcaattcctgaaactagtagaatttgaggaggatgatacgaaacctcacgagcagcaatttcaaaatcatctaagattgactccattaatggagaatgaaaagccccatttacagatagtaattgaacggctattttttggcttttgcagttggcgacaatctcatcaatactattactttccccagaaatcacaatttgttgaggatgattaatagccgcgatggaaactgtattaccatagttttgaatgagagcagataccgtagcttcatctgcaaaaactgaagccatttttcctagaggtgcagtttgcattaattgcccacgtttaacaattaatgctagacctgcttctaaactaaatactcctgcaatacaagctgcaacatattcaccaacgctatggccaattagtaaactaggtttgattccccaagattgccacaacatggcaagtgaatattctagagcaaatatagctggttgagcgtatgcagtttgattgagtaaatctgtgcgatcgccaaataatatttgttgtagtggaaactctaaataatttcctaaaatgtctgcacattgatcaatatattggcgaaatgtcggttgggtttggtaaagttgattacccatacccgcataacaagctccttgaccagtgaaaagaaagactattttagggtatttttctcctgtaaaacgtcgataaaaaatcccatgatcaatatttttttcctcagcaaaagctgctaatctttgttgcaactctgtcaatgtatctgcaacgatcgctaaacgttcaggtaaagacgacctaccaattgccgcactatgacaaatatctcccatctctggatgagactctaagcgggtgtgaaaacgtagtgctagttcttttaaacccgtttcgctatgagcagaaatcgtcaacagatggctgggacgttgcagtttaatttctggtatgttggcagcaggtgcttgttcaataattatgtgagcattggttccagaaaaaccgaaggaactgactccagcgatacggacttggccattgttcgaccagggtatggcttgactaggaattttgatcgggtatccttgccaattaatcaggggattgggttcttggaagtggagatgagacggaatctcaccatgctggagggcgagaattgtcttgattgtgcctgctatccctgcggcagcttcgagatgtccgatattagtcttaactgaaccgacgtaaagaggttgcgatcgctctccatacacagcagcgatcgcgttcatctcaatggggtcgcctaaagaagtacccgtaccatgtgcttctatataaccgacttcctggggtttgactctagcatcagctaaggcttgacgaagtaaatcttgttgggcggggccactgggaactgttaaaccggcggctgcaccgttatgattgaccgcagacccccgtagtaatgcgagaatgcgattgccatttttttcagcgacagacaggcgtttgagaactaaaaccccgcatccttcgccccgcacatatccatttgcagccgcatcaaaagtcttgcagcgaccatcgggagacatcatccccgactgacaaaggttaatcgtaattgccggatctaagatgagattgacaccacctactaaggctattttgcactcatgatttctcaagctgcgaatagcttggtgaagtgcaaccaatgaagaagcacaggctgcatcaatagacatacaaggtccgcggaggttgagaaaataagataacctacctgctgctgcacttagggagtttcctgtaccaaaaaaagaatcgatttcatcatacttgcttttgtagactgtcatcgcgtggtcaacactagtgataccgacaaacacacccacgcgatcgcctgctaaattagttggtggtaaattggcgttttctaacgcttcccacgccacctcaagtaataacctgtgttgaggatccattgaagttgcttcgcgggaagatatggagaagaaacgggcatcaaattctgtaatatcctgttgtaaaaatcccccataacgagtgttcattttgccaggagtaggctctggagcataaaattttgagatatcccaacggctttgaggaacttctacaattgcatcaagtccagcttgacaaaagttccaataagcttcaggagaactgattcctccagggaaacgacaacccattcccacaacagcaatcggctcactttgtctagtttctaattcagtaatgcgagcctgcatcgcctccatttttgtgagggttgtagctattaattttttataatctgtattttgagccatgcttttgtccgcgattttttgattgtctggtaatatctaatccggtttttcccctgaaaataaaagataatcatcaaaagccataaaccaacctctatctctcgaccaagcctcaagacctggattatcttgctggagattgatcactaaatcgtgtttactaatgcctttactggactcagcaaagtaacgcacagcagcaggccaaacatattcactaattgatacagcttggatatttacaaatccatgttttttgagtttttcaacataaatattgcggtcatattggttaacaaaaggaatacacattttcttgctattgacgcgcagccaaaagtcaatatttcgtcctactcttggcagacaatcagctaatgctaactttccaccggggcgcaaaactcgaaatgcttccgcaaaaaaatcttcacgagtattgaaatgaaaagcacattctaaagctgtaactttatcaaaagtattgtcctcacaaggaatgttagttgccgaacccacctgaagatttatacgttcagataatcccgccttagctactcgttcttgagcaatttctacttgtatttctgtcgtatttatcccagtaattgcatctacattgttttcacgcacccagagtatatcttgttcagcaaaaccgaagccgacatctaaaactttgtctccagggctaagtttggcaatttctcccaatttccgggctaaagcagcacaggctccgttataagtcgtttcctcttgccaatagccaaagttgagccattggggaacattgggatcgtgaagatcacactctcgtttagctatcctagtataaagttcagatacctcaaatttatctcgtaaaaaccaaagttcttgaagtggattctggataaattctttgatgattatccagcgattgcgccattcatagttgaaggggattttaccaatattttccaacactttactctcctatttatcaattaaaaatttttgacgcactgaaatttagctttaatatttaatcaccatattcttcaagctccgctaacttttgattaagtagtatagccaactcatcttcattgagactttcataaggattgacaatctcactagattcatttgattttatctcaaaatcaacagaatctgctaacacttctttctgcaaataaatgttgagactcgcaatattaggataatcaaagattatagatgtaggtaaagtacaagctaaattactttgcagccgatttttaaattctagtaccattaacgagtttaaacccaactctaaaaatgaggtgtggtgaggaatcacactactagcagataatccggtaacttcgcgtaaaatttgctcaattccttgcgataaattttctgctcgctcatctatagatacagactttaatcgttctaataattttgcctctttgctatctgctttagttgtaattacttcggcaaagaatggttgattaatgttaaaagcttgattaaaagtagaccaatcaatatcaagaataattccttgatcaacgtcgctgagaattaagtcactgagatatttgatagcggtatcagaaggcatactgtgaataccccaattagcaaaacgttgtttttcaattttattccctgtatcccatgcgccccacttgatactaatacctggtaatcctaaactttgtcgttgctgtattaaagcatccataaaagcattagcagcagcgtaactactttgtcccggtgaacctagaattacagcagcagaagaaaaggctatgaaaaagtctaaagatagattgcgggtgtagcggtctaataataaagtgccttccactttgggacgcataacattttgatatttttcccaattttgattagttaaaagcccatcatcaaggacagctgccgcgtgaatgactccgcgtaaggggggtaaatccgcgccaaaacgggagaatagctgttccgtatctgcggctgaggtaatatcagcattgacaattgtaatctgtgtaccatttttagttaatgaggcgatcgcttctggttgagatttgacatggcgactacacaaaaccaaatggctagatcccatttgtgataaccactgagccatgagcaagccaagtttacccaaaccacctgtaattaaataagctccctctttgctaactaattgctgtttttgggctgcgggaattgttgcagatactaaccttgctccataacggtttcctcggcgtaaagctaggcgtgactcactgcctgatgtatgaaattcgttgaacaaaaattcagcttcatgagattctacaattgctggtaaatctaaacatacacaacgaatttggggatattcatgattaattactgctcctaatccccaaagcggagattgttccggttgcaaataagtttcagataaaactcgattcgcaccacgagttactaaccataaatcaggtaattttttcatattactagtaatagtttgaattaaatacaatacagcattacaactcttgtaaactgtatctgcacttgcttcattaggtacagtttcccaagcaaaaatcacacccgtaggaaattcacccgatggatatgcttcttgatataaacgttgaaaatcagatttccgagatggattgatgacaaaactttctagagaatgacgtttataatcatcactaagttctacagtaataactctttctccagctttttgcaataaattaatcgactgatacaaagctgtgctaggacgtacaaacactaaccatgaatgttgagagtttcctgtaatagttgaaactgaatcaagcttttgccattgcacctggtaaaaacaattattttcagtttcttgccataaacgttgtaaaactgctggattaatccgccgtgctgttaagtctgtaaaccgagcgcaaagctgttcttgctcatcataaacctctacatctacacagatttcaccatcaatctgagatttaatctcaatgtgcgtccaagcttgagtaccaggattgccaaataattctagagaagagaaaccataaggtaaatgcaattcctgaccgtgaatttctgggaaagccgcgccaatactttgtaaacaagcatctaaaagcacaggatgcaaacaatatcgccgatctaccaaactgcgatcgatactaattttagcctgagaactactgctaaaatacctgagttcttgaatagcctgaaaacgctgaccatagctaattcccatctgctcataaaactcataaaatctggctagatctacagattcccttctttcatcctttgcgtctctgcgtctgtgtgtgagcttttcatgtctttcattaacgttaatctcacccgtaacatgaagtacccaactatcttttgctgaatcactactaaatatctcaaaactatagccagacgacttcttagacttaaaaatcagttgcaatttagtttgagattgagataaaactaacccctgatgaatagcaacattttgaataatcgccaaatcatcagtaaatatttgccgactagctactaaaatcgtttcaatgaaacccgtagccggaaacaagatttttccaaataccttgtgtccttccagataatctggatactcagaacttatctctccttcaacaataatttctcctgtagctagctttttaacctcatgaataaaaggatgcagtttagtcttaatatcacttacaaaaaattgtggatttgataaccaataacgttctcgttgaaacggataagtaggtaaaagaacccgctggacttgcttaaatacctctgtccattctatagaataaccattaacaaaaagtgttgctaaacttctgtacatctgggcttgttcatcttgtccaggtacaatgctgggtagccataatatttctttgctttgagaatttagccgcgccatacctaataacacaggctttggtcctaactccaaaaaatggcgataaccactgtcaattaacaatttaaatccttgaccaaaatgtacagtattgcgaagatggcgcagccaataatcggcagtagcaatttctttgccaattggtttacctgtgacattactaataatattcaggcttggttcatggaaagaaacttgctgtaacatcttagcaaaatcatcaaggattggctccattaaaggagaatgaaaagcatgagatactgccaaacgtctagttttataaccttgctccataaatgatttctctagttgttcaacaatttcactcaagccagaaataacattaattgcaccattatctgcggcaatatttacttgatttccatagggagtcagatgatcggctactgtttgataatcagcataaattgctgccattgctccattatgcggtagttctcccatcaagcgaccgcgttgaacaactaactgcaaagcatcttctaaagaaaagactcctgctaaacaagcggcgacatattcaccaatactgtgtcctaaaagggcagcaggttgtattccccaagattgccataatttcgcaagtgcgtattccagtgaaaacagggctggttgtgtgatttgagtctgttctagctgttcactattttgcaattgaaaaattaaacctaagagcgactttcctaaaataggttgcagaatgttgtcacaaagttccagagtatttttaaagacgggttcttggttgtaaagagtttgtcccatccctgaatattgagaaccttgtcctgaaaataggaaaactacttttgtttgagtttctgatgtaattggagtaattaaattatcagaatcttcacctttttggaaatcagcaagtgctttttcggctgtagtatttgagtcagccaagacacacaatcgatgccggaaaatagcccttcctgtactggcagtaaaacaagtatctgcgaaattcacagattcatttaaagcgtattgataattttttgctaattctttgagagatttttgagaacgagccgaaagcggcaggaggtaaaatttctgctcagatggctgtggagaattagatgcaatttctccaacaataatatgagcattagtaccactaaatccaaaagaacttactccagcaatgcgttctcgttggctaggatgccagttttttccatgtactggaacttcaaaaatctgagaactccaatcaaaacgggggttgggttgttgaaagtgaagatggggaggaattttgtgatgttgtagggctaaaacagttttaattaacccagcaattccggctgctccttctaaatgtcctaaattagttttgacagaaccaataattaaaggtcgattttggagacgtttgccaaataccgcagccatactttctaattcaatcggatcgcctaaagctgtcccagtaccatgagcttcaataaaatctatttgctctgggttgagtttcgccgcctttaatgcttgatgtaataatttttcttgagcatcaccattaggtacagtcaaaccactacttgatccatcgtgatttacggctgtactatgaactttagctaaaatgtgatcgccacttttaacggcttgactcaaccgcttgagaacaatcatcccgcagccttcgccccgtaccataccattagcactcgcatcaaaagtcttgcaacgtccatcaggtgcaagcatatgggcgcgactttcaattaaggaaattaccggagttaaaattatattcacaccacctgctaaggcaatgtcacactcaccattacgcaaagcattgcaagctagatgtactgctactaaagaagaagaacaagcagtatcaactgtcattgatggtccctgtaagcccagtacatacgaaatacgaccggcagctacactcagagaagtgccagaaccagtataggcgttaattgcttctggtgcgtaactcaactgggcatagtcttgagtcatcgcccccacaaaaacccctgtttgagtgttgcgtaacttttgggggttttgcccagcagattctaaggcttgccaagttgtttctaatagtaggcgttgctgaggatcgatggcgactgcttcgcgggggacaatgccaaagaattcggcatcaaattgatctatttgctctagaaatgctccgtaaggagaatagatttttcctggtgtatctggatcgggatgataccatgcttgcatatcccagcgatcgctgggaatttctctgactgcatctttcccctgttctaaaagttgccagaatgattccaaatcattcgcaccgccaggaaatcgacaagccatccctacaatcacaattggatcttcttcctgttgcggtttttcgggggtatatttttcaatttggatttggggaacttcttgtattagttgttgtacaggagtttgcacctcagaggtaactaaaatttcccgcaggagataatctgctaaagtttccacattgggaaaccgaaaagcgattgttgtgggtagagagcaattaaaatctgtttgcagaagattgcgaagttctgtggaagtgagagaatccatccccatgtcaaaaaagccttgttggggagatacttcatgagttgatagtcctaatacagtgcaaactcgcaaactaatttggcggataagtaaatcacgacgctgttttacaggtatgatttgccactgttctaaaagattggatgcagtttgagatttaggtttgatttggggtaagaagttttgataaaagctttgattaatgtatggaaaacgttgccaatcaatagcaattacaccagcacgtacaatttgattaaacagaattttttctagagtattgagtgctaaatctggtgcgatcgcatcataacctttggctgctaatctttctaagacattgcgatcgactgctgcaccgatttcgctccacggcccccagttgatgactgtagctggtaaattgtgtgcatgacgataataggtaaaggcatcttcaaaggcattcgcagccgcagcattagcttgtcccgccgaaccaatgagcgacacagcagaggtataacaaacaaagaaatctaaggtatcgttcagggttagttgatgcagtagccaagttcctttcaccttgggggcgagaacatagttgaaacgttctggtgtcagtcgcagtaatgttgtatcgtctaaagtgccagcgatgtggaaaattcctcgcaacggatattgcgatcggcattcttctagtagggcgtgcagtttctcggcatctgtgacatcaacatctttaatttggatgtcttcgttaatggattgcagacttgctagaatttcaggattgagagcttttgcaccactgcgactgcacaatactaaatggcacgcgccatgttctatcatccatcgggcagtggctaaacctaatccgcctgtaccaccagaaattagataaaagccatcttgacggaaattgatgtttccatctgctaatttgcgctctaccaaacgcggacagaagcgttgttcgccccgcaaagcgacgcggttttcttgggtgttgttgtggatttctctaaataatttttctcctaaatcttgtgcatgaggatctaaatcaatcgctctaaaatttagttcgggatgctctagaactaagcttaaagccattcctaataaggaagattgggctggagaagttaaggttgtgatttcttttgctggtacagacccttgagtaacaagaatgagcgcgggggggttttcttgttgtaataatgcctgaagtagaaatagaaaacgtctacaatgaatttctacagcttgataaatttcgccttctatttcttgtaatgaccagaggtagatgatttcacgggtttctggtgttatcaggttttgtaatagtgataggtaatcgtcggggttatcggggttaatgtcttgaggggagatgagggaacaagtaattcctcgctgttggaatggggtgattaaactgcgagcaattccgttagtgtcagcaaagattatttcgcgccaagacacagaggtgcatagagaaggaaggctgcttttggcgatgattacgctttgttgtaataggttccgtgtctttggattggttggttcgatgatgttaatttctgtaaattgatgcttggcgagtaggttttgccaatgttctgtatctactaatggataaccattgcggtgcggatcttgactgcataaccaccatccttctgttaacccaaaggttaaatctacccaaggacgcgctccggtactttctaatagtatgagtatggcattaggagctagtaaagaacggacattattaagggtttcattaatatctgctgtggcatgaaggacgttagcagcaataataatatcaaaataactaggtagaaatccttgagaaatgggggctttttctatatctaaagtttgatatttaatgaagggataattactgaaattttctttggctctggttaaaaagctagaagaaatatcggtaaatgtgtattcaatttgttctggaggtaaatgtggtaaaattgctgcggtacttgagcctgttccccctccaatttcgaggatgcgtaactgtcgatttgttggtaaatttgctactacagttttaattgtggctgcgactagttcattcatcaacttagcaccagccgcatcagaatatacagatgcgatcgcattcaaatcgccttggggaaatagtaattctaatggctcaatttggcggcgcattaccgcagctaaagccgaaccacaacgttctatcaaattaatttctgcaaggtaatcaggaaattccctacgtagttgttgaattggtaattgagatgaagatataacaggttcttttgctaataaccatccatctttttgctgagtaattattccttcttcagctagaattgctaaacaccgcgacaataaaggacgataaaaatcaacaactccaccttgagtagcaatctgttcttctggataaatttgacctaattggggttgccagttaagctcttttaaaccttcccatatataacttacgcttaaagtttccatttcttcaagcaagcgttcatattggtacaatttttcagctaattgctgttctaattgctggggttgaactagagttttaatggcatcagggtttagtaaataatctctaccatcaggtaacaatgatgctaaagtaatccactcctccatgtaagattgtggttggatttgatggcggataatttcttgactttgaactgatttaagttcaaatcctgtaattgctactagtaactcaccttgttctgaataaatatcaatattagagataatatagttattagaatttttagttagtcgagctgcactgatgacactagcacctggggacttgaagaattgaaatttagcaatgcggactgggacataagttacagatgattcttgctgaaataaaattgcagcgatcgcctgaaaacaagcatccaacattactggatgaaacttatatttttcggcttctagacactgaatttgtgttaacttgattttagcaaatgcactatttttgccacgttgaagcttattaatgatctggaagctactgccgtaattaactcctgatttttgatatctttcataaaatgaattaatttccatctgctctggacagttagcagctatttgttctagattttggcgatttgcatctagtatatttaaactatcaattcccccggtaacaagtacatcccaattattattactttgctgatatatttgaaaacaattttgttcaataattaactgtaatgtatcctcttgttcttgcagcaatagtgctttttgaaattcgatattttctaaaattacagcttggctttgtgccgctgctaacgccatttcaataaaagctgcaccaggaaatatcggtttatcaaaaacttgatgttctgttaaaaattctgggttgttctgactaatactagctcgatattgaatagaagagaggggagaggggaagcgatcgcctaataaagggtgtccagagcgatttgatttaatagcatctacccagtagcgtttgcgaataaaaggagaactgggcaaactaattttttgtcctgagcaagagcgatggaattcttgccaattaatatttactcctcttacatatagttcagctatgactgtttggatttgctgataattactgcaatcttttgctaaactacataagcaaaggatttcttttgctggtaatttactatgaacgatattatttatgggctgatttccaatctctagaaatatttgatagcccatctgatgtaaggtaaaaatccctttttcaatattgtctaggtgatgtagctgttgcaaccagtaagcagcagttttaatataattattagcaacctcaccattattagaaattaaagtgagttgtggattacgataagaaacttcttcagctactttttgaaaagctaaaaattctttttctccactttgctcgctaaataaatgaacgcgagttgccactaatttaactgcatctccaatcgaaaaaattccagcttgttgagcagcaatatattcgcctaaaccatttcctaaaattgcagaagggcggattccccaagatttccagagttcacaaagagcatattgcagcgcaaataatgttgggtgaacatataaaggatcgtttatatcttgattgttatcaagtaagtcttctatagagaaatttaaatagttttgaaataggcgatcgcattgcatcaaagcatcacgaaatacaggctcatttacaaaaagctctttccccatcgccggaaatatagttcttgcatcattgcaaacaaaagcgattttagtatttactcgtacctcaccgtaaatgatattagcttctcggtcattaccattaacaaaagctcgaagttgttctttaaaactagcagtattggaaactaataaagttaatcgctgtttatgatgaaaacgacctgtatttacagaaaaggcgatatcagttaagttaacttccggtttttggtcaatataattaacaaagttagcagccaacagacgcaatcgttcttcatctttagcagacagagttaccagtacaggaaatgttgttttagttgaggattgtacttgcggaggttcactcaatattgcatgagcatttgttcccgatgctccaaaagaactgactccagccgcttttatcttgccattgccttgagtccaggggcgagtctgtgtcaccacgtgcagaggtatgctatcccaattaatgtgaggatttggtttttggaaattgagatgtgccggaatttcgccatgatagatagataatatagtcttgatcaagccagaaatccccgccgccgccgctagatgaccaagatttgttttgacagaaccgattaacaaaggttgggatggagagcgattgacacataaagcatcagcgatcgctttaatttcaatcggatctcctaaagatgtacccgtaccgtgagcctcgacataatcaatagcattggcacttagacgagcatcagctaaagcatcacgaattaaatctgtctgcataggtccattaggaacagtaaaaccgccactggcaccatcgttattgacagatgttcctcgaattaacgcccaaatgcgatcactatctgctaaggcttcactcaacctttttaaaacaacaactccgcaaccttcaccaatcccaaatccgtcagcactttcgtcaaaggttttgcacctaccgtcagcagctaacatctgatttctgcacaaggcgatcggcacttccggggtgagaattaggtttactccccccaccaaagcttgccgacattcctgggagcgcaaagaacggcaagctaaatgcactgctaccagtgaagaagaacaagccgtatcgatagccaaactagggccattgagattcaaaagataagaaatgcgtccagcagcagcatttatatggttgccagagatatgataagcccctattgtgctataatctcctcccggtgcaatcagacgagcataatcattgtttgtgatgccaataaaaacaccggttttgccgattctggcagtaggcgcagccataccagcatcttctaacgcctcatagccaacttctaaaagtaaccgttgctgaggatcgatatgcaaagcttctctcggtgcaatcccaaaaaagtgcgcgtcaaacatcgacacgtcattgagaaaaccgccttgagatacatagattttgccgggtttactacgatctgagtcataaaaatcagacacattccagcgatcgctaggtacatctgtgagcgtattaccaccagctttgagaaaagaccaaaaagcttcaggagtggaaatatttttaccaaaacgacaacccaaacccacaaccgcaatcggttcgctttgttgagcttcaacagcttttaatctctccttcgcttcatttagcgccttaaacaccctagcttggacagacttatcgttacttatctccaactccatcttttctccttcccctcttcctctgcgtctacctaagtttgcttaacgagggttcccctagcaccgcaacttctctctgcgtgagctaaaaaatcaagaattacctaaaaaagcctctaaatctgcaagctcttgtaaaaataaatcctgatcaacctcctcctgaataggaacaacatttacagaagcattaacctgccaactaaacacctgttccactaaataatcaactaatcttctaatgttaggaaaatcaaatatcaaagaagcaggtaaagccacttccaatcctttctctaaacgattttttaattcaatcgaaagcaaagaatcaatccccatttctaaaaatccttgttcggtatctggtatctgtttatttcctaaaattgtccctacttgtttgccaatatattcaaacaaatgttgccgacgttctcctggtggaatttcttctagaaaacgacgtgtagagattgactgttgaattcctttaactgaattttggtattctcctaatttttcaaaaattggtttattgcctttagattgataaatatttttgaatcgcacccaatctacatcagctagtaagatttgtgtttttccagattccataacagcggtcattgctgcaaaagctttatctaaagcaatttctttcataccaatttgtttgagccaatcttcataatcttgagaaactatgccatttccagctaataatgcccaattcaaactagtagctggtaatttttgaagatgacgtaaatgagctaaagcatccataaaatgactagcagtatcgtataaaccttgctctttagctccccaaattgcacctgcggtagagaacaaaacaaagtagtctaattgagttgctaaagataactgatgcaaattccaagaaccgcgaacttttgcctgaaaaacttctgcaatatcatctaatgtacattcgcttaatttagctttgcgtcctgacactccggcaagatggaaaataccccggagcggatcagatattttttgaattttggtaaagatgcgtgacatttgctcaaaatctcccacatctgcttgacaaacttctacagttgctcccttttgttctaaagtcttgatattttgaattatttccccaaattctgcttgtgaatcccactctgctcgtagtggaaattgacgacgtgtagtcaaaatgaggtgttttgcgcccaaatcaaccagatggcgagcaagttgtaatcctagatgaccaatacctcctgtaatcaaataagtagcttgagcttggatagtgactggttttgtaggtagagattccagtggggaaagacgcgcaacgtaagcttgacctttgcggaacatcagatgatcttcggtgacagagttagtcaatcctgagagtaaagcaacaagattttgagcaatatcggcgtggggacagaggtctatcattcccccccatagttctggttcttctagccccatcacgcgccccaacgcccaaagcggagactgagtaacaaaagatggctgctctaatcgaaagggttgaccaccttgggtaacgaggaataatttgggaggatgaggtatttttttaatcgcctggagaagatttaaaagatggtgacagcgattgaataaagtagactcatactgatcgccctcaccaccattcacaagataaataattccacgccaacagagagatgaagccagccgtgtttctagctcagagctattttctaaattggcgatcgcacaagatccacaatctttgcttagttgctgttgaattgctagagctagattatctgtttcactatcggtaaaaattagccaattacccgaaatatcgctgcttttttcggcattttgggcaacaataatactttgctgaaataaaggactgccaattttttcgtcaggagaaataaattcagcttgagcaaaaccagattctcggagaatagattgccaagtagatgctgcaataatgggatgatctgagcgtaaatcgcgatcgctaaaacgccaccaaccttgagtcacgccaaatattaaatcaatccaccgggactgatgagtaagttctaggagtaacaagtgtcctccaggacgcagtaaacctcgaatatggggtaaggtttctccttgtaaatcccgcgtagaatgcaatacatttgctgcaataattagatcgtaagaaccgggtaaaaaaccttgaatttcggggtctttttctatgtccaaaactttgtattctatgaaagaatgagcaaaagtatctttggcagtctctagaaagaatggcgagatatcagtaaatgtgtagttaatttgacgagaagcacaagcttggagaatttgatgggtagtagctccagttcccgcaccaatttctagaattcggattggttctaatggagaatagtttgataataaaagctctactgttttagagatactaaggttgagaacttttgcccaagatgtgtttttataaaactctgctactccaatttgcccgtcttgagcaaataagatggataaaggagaaatcttcccggtaattatggctgcaagattgaccgcaactcgcttaaacagcgttaattctatggaagcatttggatactgaacaatcaaatcatctactgttaaatcagagtgagattgttgcggttcactgatgattttccagcccaaaccctgcttttctagaaagcctgtttgtgccaatatttttaagcagtgctgccatagtaatctatactcctctttaatgccagcctgacgtaaactattttctggagagaggatagtatttatttgccataatcccaaatcttttaacgttttcacaataaagttggcactaagttcttccatttgggaaaaagctagagaaactcctgtaaattgtgtagatttgatttgttctgacaaataagagcctaaatcagtttgaattatttctaaattctctaatttcttagctgataaaagatgaggtagccactctaactgataaagtaagttatcaaaattagaattacctgtgtcttgatgatgtagctgaattaattgttgaacaattgccgataaagtttgtttttcagcttcagaataattcccagtttctattagagtctggatcaaattgtttgtatctttttgagacaacatcttgacaacagcagattccttggcagtttggaattgagtttttaagggaatccaatgttgacgttgctgaaaaggataagttggtaaagcacatcttttaggttggtaatctttttcaagtccaaaccaatctatatttgcaccacgtacataaagtttacctagactttctagtagaacttcccaatcagaaaatcctgagcgtaaactcggtaatattagagggttagataaagatatcgatgactgaataatgcctaaaagaacaggttgtggtccaatttcgataaaactatcacatccaagagattctagagacacaactccttgataaaattgcacaggatgcagcaaatgttgaatccaataatcaggagtaacaatactgtcatctgcaatttctcctgtcaggttagagataataggaatttggggtttagcaaaatcaatttcttgcagggtatttttaaattctccacatacgggtgctattaatggtgaatgaaaagcatgagaaacctttaattggcgaacttttactccagcgttaataaagtgttcgctaagttgttgaatgattgtttgttcgccggaaattactgtatgttgttttgcattgattgctgcgatcgcaacttttatcccctgatttttacacaattgccgcacagatgtttcatccagaaaaacggcagccatcgctccttgctctgcgggtaatccaccaattaaatttgctctttgtacgaccagttttaaaccactttcaatatcaaaaactcctgcaaaacaagcagccgcatactcgcccaagctatgccctaaaacagcagtaggctcaatgccccaaaaacgccataattgagctagtgctacttcgacaacaaataaagctggttgggtataagatgtatgatttaaagctacatcagaattagcaaagatgacttgcagtaaagatctacctgttagttcttgatatattgtttcacattggtctaaagttcgccggaaagttggttgggtttgatagagttggttagccattcccagatactgagaaccctgtcctgtgaacaaaaaggcaattttgggaggctgcttttcatcaacttgagcgtgaattactgactctatattttgttgtccaaactgatgtaatttagtaacaaaatcatcaatttggcaaccagtcaccgctaaacgattctggaaatgaactcggctagtattggctgtgaatactatatcggagatatcgctggcgggatgattttgaagaaattctgcatagctttttgctaaatctaccaaagcctgttctgttctggcagaaagtgtgagtaaatggtggggacgcttgatgtcattggactggggaataatggcgggcgcttcttccagcaccacatgagcattcacgccaccaattcctaaagagttaaccccagcgcgtcgaggcaactccttgccatcttcttgctttgcagtccagggtatggctgcggtattgacataaaaaggagtctgggaaaaatcaatctgggggttgggagtattgaagtgtaaagtcgggggaataatttgatgtttgagagccaaagcagctttgattagaccaacaataccagaagcaatttgcatatgcccgatattggtcttcaccgatcccaaagcacactctccctgatttgcagtgctatatgctctagccaaagcatcgatttcgataggatctcccagttttgtacctgtgccatgagcttctacaaagccaatggtatcagcttcgactccggcaaaggctagtgcttcggctgctactaaagtttgaccttctcctccaggagctgtaaatcctagctttctaccgccatcgttattgatggcagatcccttaatcacagcgtagatatgatcgttatctgctagagcgtcttttaatctcttgagcaaaacaactccaaccccactgccaaaaatagtaccattcgcttgggcatcaaaggcgcgacaatgcccatcaggagatacaatcaaaccttcttgatacaaataaccaatcttttggggagagttgatagaagcagctccagccaaagccatgtcactttcaccgttcaacagactttgacaggctagatgcacaactactagtccagtggaacaggctgtttggacattcacactaggtccacgcaggttcaatttataggaaatccgtgtagtcaaatagtctttatcgttagccaccatcgtttgaaaccctcccatcgaatctaatgtgaagggttgtaactcgtcgttggcatctaattgaccgcgatacggatagcaattattaataaaataggtgttcatgcttgccccagcaaacatcccgatcgctccctcataggagttaggattatagccagcgttttctaaacactcccagctacattgcagcagtaaacgttgctggggatcgagtaattctgcttctcggtctgtgtatccaaaaaactcattatcaaaggattctaccttgtcgagaatcggtctagctttgacatagttaggctgctggaaaagttcaggagcaacccccgactctagtagttcttcttcagaaaagaaggatattgtttcgactccgtttttgagattttcccaaaaactatctatgttgttagctccaggaaatcgacctgccataccaataatagcaatatcatgagtgtcctgatggcgacgcgaacgattttcggcgcgttttcgacttttttctgctataacatttgtggtattagattcttcagttaagaaatgggctaatgtggcaactgtagaatttttaaatatttcagttagaggtatctggcgaccaaaaagtttttctaattggttttggacacgaattaggtgtagagaattccctcctaattcaaagaagttatcctgtatacctactgaatcaagttgtaaaatctcacaccaaactgctgctatttggcgttcattttcagactgtggtaagctggcgtttttttggcgatcgctcgctaaatattcattgattgcttggatgcgatcactaaataatccctgttcaaaatctttttttaatttagctttttgaaccttaccaatagatgttttgggaattaactcagccgccaaaggaatcacataagcaggtgcaattcctactttctgcgttaaatggctgcgaatttgtctgactacttttactgcattatcaagattatttgattccggattaaaagtaataactaataaatctgtttctctgttttggtcgaaaactgcaaaggcagccgtataggaaatagctacaccatctaattcttctatcgctgtttcaatttcatgggcgaagtagttaataccgttaataataatttcttgtttctctctaccagtaataactaattcaccattgtgtagataacctaaatctccagtagtaaaccaacctccatcttgaaaaacttcttggttaagatcgggattattataatatccttcagttacagaaggtcctttaatctgaagtcgtccaacttcgttttctggcaaaatattattctcttggtcaataattctaatagtagctccaggaatagggcgacctagagagacaaaactattttcttctatcaattcatctttgcttaaacctgctgaccaagtaattccagaacaagattcagtcatcccgaatgctggtttaattactctatcccgcaatttatgtttttctagaatttctaaaaacaagcgaatagttttgaccgaaacttgctctccggcattaactaaaaatttgattgaggagaggtcataacaagattggttaagttcttcagtatgctgattaattaaggagaatgcaaagttgggagaccaagagatagtagcttgatacttttgaattagtcctaaccatttgagtggttgacgtaaaattaattcaattggcacatggatttgatgacaagccaaatccacagccataattcctaaaaatactattgcccctacatggtctaagggcatccaatttagggtaacttcttgtcgtgtaaaattattcatccgcactgtaccgacggacatagataaaaggttgcgatgatgcaacatcactcccttgggtagtcctgtactaccagaagtaaatagtagtaatgctggatctaatggtgtaagatgaggtaattcatgagccgacagttggtttgatagagattgattacttcgtaatttatctatcgatactacccgcaattcctttaaatgagattgagtagttaatttttctattttgctaattaattcacaatccgttaatataataggcttctctaaaatctgccagacattttcaagttttttaactgcggcattttgtatatcataattgggagcgatgctcaaaggtgcaggtataatcccacctaaaaaacaagcccaaagtgcaggaataaaatcttgatttctcccaatttgtaatatggctttatctcctaatttaagtccgcgtcgataaagcccatctaaaataatcagagcatcattatataaatctttataagtctgaaaatattgactttcgtcacttctaatatatgtaataccttgactttcgtacttagcagcatcactcaatacttctggaagagtccgccagatatcttctaattggtcaccaaagagcattgcattatcctgttgacgcagcagtgtctcctgttcctctacactttcttggaagtctatctgtgttacccctgtcattacatgcctttattgctagcttttatatttttactatttgtcgcattcttttttcgattcggtgtcatattacaaaaattgattaacagcaaacaaccgtacaattcaaaaaaacaatgtattcattttgatgtttatagtcttcttatatcttgcaccgggaaatttgattgtcaatttcatgactaaatgcaatccggggcattcgtttaaggttgagtaaaaaaaaacacaaaagtaattgtagaaatattgtttgaaatgcaatttgtgccgcgatgccccaatgcgccaaaatgtaagcaaaaagtcaaaagaagtaggggagcagaggggagagactgggacaaagcttgtatcccgtcccaagccaagcgccctggaagggcggggcttcttacccatgctccgcaacgcttgtcgcagagaggaagggcttgctctccctgctagaaagcccccttcccctctgccttttcggtgagggtacaaaccaacgataaactcctagtggtctgtcaagcaaaaaattgtgagtttgagggaaaatagagatgtaagtagtattacttgctaaaccaatcatttaatatagataaactttgtaaattctattcttaagttctgtatagatatttatagtatagtaaaggtaaaatctagtgatcgctgctggaactgccatgaatcaaaaagaaaactaagtttgatggggagatgctcgtgtgagcgatccctacttaaaaaaaatttacaatgcagttaattgcaagcaaatctatctatacaagcattttggctgtcacttaaattccagggtgaaaaataaatgaaattttttcttaattacctattgtatccaaaacgcttatgctgtaaatttaacatttaaggctctataccaattctctatgaaactagcacttaataagttcctcttttttcttagccttaaaatttttgaacccgcgtaggcgtgttgtatctgtgtagccaagccagtgcggtggtgagccatcactgcgggagaatttaccgccataaagcatctggcgcgcaaatttagtcaccaaggcttaaacaatatcacactaattactatcttgaattagtcagaacttgaattagtcaaaaaatatgtgactaatagtggaattttaatgtaaaaaaatatcatctaaatttttggagaagtttatggacgtgatagaaacacatcttgtttcaatagattatcaaattcgacaactgcgagaaatccagccagtcacaactttatttaatattggaattcaaaataaaatagaaaaacaagacaaaataattgatattatatctatagagctacgcgataaaatatataatttaactactaattctcctgttaataacctagctttatatctatcagttattaaatttttaatatttaaatatactgctcaagaacaatttattgtagcaacgggagctttgaacctagacaagtctaatagcttaatattctccagatttgacaaacaaaagcttatttcatttaaggatttacttaaaataactcgcagtaatctccaagaaggataccgttaccaaaattatgatgtagacagtcttgtagaaacgtttattgccagaggcggaaatccagcagcggtttttgatattgccctaatccacaagggattatgcagtcacagttctttgttaaacaactttcaattagtctttgaaattgatgctcaagatacttctgtttctgtaactttcccaaaagatgcttttagtgcagattttgttcagagaatgctggcacattttcggcaaattatagaaactgttacagttaatcctgattgtaaattgtcagaaattgatatattaacaacagaagaacgtaatcaattaattagaaaatggaataatacagagatccaatattcccaaaaatgcatccatcaactatttgaagagcaagtagagcgtagccccgatgcaatagcagtagtatttgacaatcagcaattaacctatcgccatttaaatgagcgggctaatcagttagcgcactatttgcaaaaattaggtgtaaaaccagaattactagtaggtatttgcatagagcgttccctagaaatgatagtgggactgttgggaattttaaaagctggaggagcgtatgtaccattagaccctagctatcccaaagaacgcttgagttatatgcttgaagatacgggggtgaaagttttgctcacccagcgttcgcttactgaactcttaccagagaatcaagcgattgtagtgtctttggatggagattggcaagttatagctcaagagaatcagaacaatctcaacagtggcgtgaaaggagagaacttagcttatgtaatttatacctctggctctacaggtaagccaaagggagcaatgaatacccataaaggcattagtaatcgcttagtgtggatgcagaatacttatcagttaacatccagcgatcgcattctccaaaaaactcccttcagtttcgatgtttcagtatgggaattcttttggccgttattggcaggtgcaactttggtagtggtgaaacctcaagggcataaagataatacttacttaatcaagctgatacaacagcaacaaattacgacaatccattttgtgccttcgatgctgcgagtgtttctgcaagaaccaagcttagaaaattgcagttgcttaaagcgagtgatttgtagtggagaagcactaccttatgaactgacacaacgtttttttgagcggttaaactgcgaactacacaatctctatggaccaacagaagcagcaattgatgtcacattttggcattgtttaccacagattcaacagcagatagttcccattggtcgtcccattgccaacacccaaatttacatcctcgatcaatatttgcaaccagttccagttggtatagcaggagaattacatatcggtggtgtgggtttagcccgtggctaccttaaccgtcctgaattaacttctcacaaattcatttctcattccttcggtgatggcaaattatataaaacaggtgatttagctcgctatttacccgatggcaatattgaatttctcggtcgtatcgaccaccaagttaagattcgcggcttccgcattgaactaggagaaatcgagactgtactcagccaccacccagcagtagaacagtctatagttatagttcacgaggaagaaactggacataaaagcctcattgcttacatcgtcggaaattctcaacccagcgatgctgttgagcataaccaagaagtaaatttatttgacgaacaaatattgcaatggcaaatgctctacaaccagacttacagccaagctaacctagagccagacccgatgtttaatatagtcggctggaacagtagctacacaggtcagccaattccagcagtacaaatgcgtgattggctaaacgacaaagttgagacaattcttgcccagcaaccaaatcgagtccttgaaattggttgtggaacaggactaattttattccaaattgctccgtactgccgccattattggggaacagacatctcatcaaggggactagactacattcagcagcacttgagcaaaccagagtcacaactgcaccatgtgaatctatcgcagcgtccagcagataattttgagggtttagaggcacaaggatttgacaccatcatccttaactcagttgtgcagtacttcccccatattgattatttgttgcgtgtcttagaaggagcagtgaatacagtcgcccctggaggctgtattttcctgggagatgtgcggaatctgcaattactagaagctttccacacctctgtagaactgcataaagcttcgcccgatttatctgtagcccaatggcaacagcaggtgcagaggcgaattgcccaagaaaatgaactgctgattgacccagccttctttgcggctattcaacagcgttttccccaaattactcatgtgcagatccatctacaacgaggtcagcaccataacgaactgactcaatttcgttataacgtcctactgtatgtgggaactacggtggatgtcccccatgatattcagtggttggactggcagaaccaaaaacttacattggctatggtacaacatctgctagcagaggcgaaacctgagatactgggcattacacggttactaaatccacgattaattaaacctttaaaaaccttagaattactgaaaaatcctcacaaattccagacagtgagccaattgcgtcaggacatagatgcgatttctccagaggcaggagtagaacttgatgacttatatgctttagctgaggctttgtcttattctttagttgttagttggtcagactctagtgtcttaggctattacgatgtcatctttgtgcaacaccaaagtcaggcaaaagtccctctgagagtcttcactcctacaaacggtcaagccaaacccttgcatgactggcaattttatgcgaaccagcccttacagccaaggttgaaccgtcaactcataccccaactgcgtagttatttagaatcacgtctaccagagtacatgatgccaaatgctttcgtcatgttggatgctataccactgacagccaatggcaaaatcgaccgtcgtgccttaccatctctagaacaaatccgtctcgagttggcaaacacctatgttgcgccatgtactcccattgaagaaatattagctgtaatttgggctgaagttctggggatcgaacaggtgggtatccatgacaacttttttgaactaggaggagactcaattcggggtatccaagtgatcgccaaagctaaacaaattggcttcgatttttctctaccacagctattacaatatcagacaatccaagaattggctggtttagttagccgcgaactgggttttttacccacaccaaaaacagaagccttcagcctcatctctgacgaacagcgcctaaatttgccagaggatgtagaagatgcctatccgcttgcagcactacaggcagggatgatcttccacagtgagtatagtaatgatgtctcgatctaccacgatgtctttacttattacattcgagccactcttgacccccaggctttacacagtgccattcaacaggtagtaaatcgtcatccggtgctacgtaccagctttgttctgactgactacaagcagccactacaactggttcatcaacaagtagatgttcctttaaaggtagacgatctcagccatttatcgactactgaacaagaagtatcgcttgatgcctggattgaacaagagaaaaaacgacattttgattggggtgttccgcctttactacgcttttatgttcatcgccgcacctctgagacatttaatttaactttgagcttccaccactctattcttgacggctggagtgaggcctcgttgctcactgaattattgcaacaatatttatatcttctaggtaaagacgttcttcctctgtcagcaccacccacaattacctttcgagattttgtcgcattagagcaaacaactcttcatactcaagaatgccaaaaatattggcaaaagcaactcagcgacatcattattaccaaactgccacggtggtcaaagtcgaacgctgccactaaaaattgcgatttgccagtttctatatcttctagagtttctcagggtttaaaacagttaagtaaagccacgggaatacctcttaaaagtgttttattagcggctcatttaagggtattgagcttattaactaaccagacagatattatcacaggtttagtatctaatggcagactagaagatactgatggagaaaaagtattagggttatttcttaatactttgccattgcgtttaaaactccttggtggcagttggatagacctagtaaggcagacctttgatgctgaacgggaatgcttaccttggcgaagatatcccctggctgaattgcaacggacttttggtggacagcccttgtttgagactgcgtttaactttgttcatttccacgtttaccaaagtattatcggtgttaaagatttagaagtattagatggtaaattttttaatcaaactaactttgctttactagctaactttagtctccatccaatttcttacaaagtagagtttaccctgaaatacgatcccagccaattctgtaaagaacagatgaaaatgattggcggatactatcaagaagctctaacagcaatggccaatcaatggtcagaactatatgaaaagcattgtttactctcagataaagaacagtatcaactgttagtagaatggaataataccaaagctaactatccgcaagacaaatgtattcatcagctatttgaagaacaagtagaacgtagtcccaatgcagtagcggtagtatttgaaaatcaacaattaacctatcaagagttaaatgagcaagctaatcaactagcccattatttacaaacaaaaggcgtaaaaccagaagtactagtaggcatttgtctagagcgttcccctcaaatggtcgtaggactattaggcattctcaaggcaggtggggcatatgtaccattagatccaacctacccaacacagcgtctagagatgattttggctgattcccaggtatcggtgttactcacacaacagaaattagtggcaagattacctgaaaacaaagctgacatggtgatattaaatacagatggcggggacatttccttaaagaataagaaaaatcctatcagtcaggttaattctcgcaactcggcttacgcaatttatacttccggctcaacaggcaaacccaaaggcgtagtcattgagcatcacagcactataactctcttgtgttgggcaaaacaagtctttactactgacgaactagcgggtgttttggcttcaacttcgatttgttttgatttgtcagtcttcgagctatttgtacccttggcttggggaggtaaggtcattctggcacagaatgccttagatttacctagcttacaagctcaagaggtgacattaattaatacagtaccaaccgcgatcgctcaactgctacaaatcaagggtatacctaattgtgtgcaaacaattaacctcgcaggtgaaccattatcaaatcaactggcacagcaactttaccagcaggaaaatattcagcgagtttacaatctctacggaccgtccgaagatacaacctactcaacatttagtttggtgcaaaaaggggcaattaagcaacctagtattgggcgaccaatttctaatacccaaatctacattttcaaccccgatctccaacctgtacccattggtattgttggggaattatacattggtggggaaggtttagccagaggctaccttaaccaacccgaattaacttcccagaaattcattgccaacccctttgataattcccaaaaattgtataagactggggatttagctcgctatttaccggatggcaatatagaatttcttggtcgcatcgataaccaagttaaacttcgcggcttccgcattgaattaggagaagttgaatctgtcctagaaacttatccgcaaattcaacaagcagtagtcatgctgcgggaagacactcctggtaacaaacgactggtagcttatttagtcacacagaaccagtctataagcatgagtgatttgcgccgtttcttacagcagaaattgccagattacataattccttccagtttcgtcatcttgtcaactttgccattaacccccaatggtaaggtagaccgcaagatgttacctgcaccagaagcagaactgacacgagaacaagagtttgttccgccacagacacctgttgagcagattttagccacgatttggcaagatgtcttgggaattaagcaagtaagtcgctacgataaattctttgaagtcggtggtgactccatcctcagtattcaagtagtcggtcgcgctcgtcaagcaggaatcaaaatcaccccacgacaaatattccaatattcaacccttgccgaactagctgctgtagctgatacttgcacattgatgttggttcaacagggtttagtgacaggatttgtacctctaactccgattcaacattggttctttgagcaaaatcgatctgaaccgcaccatttcaatcaatcagtactgctgcaaattccctctgatctcaaaccagagttactgtcccaagctattggcaaattattagagcatcatgatgctttacgtttgcggtttagctttgaggaaggtgaatggcagcaaatcaactatggcatttctgatgaagtacctttccaagtcatcgacttatcccaaactcctcaatcacaactaccacaaatcttagagcaaatagcgactatccaacaggctagcctaaatctctcagatgggccattaatgagagtggtattgtttcaattagggaataaccaagatagtcgattactgatcgttatccatcatctagcggtcgatggggtctcctggcggattttactagaagatttgttcacagtttaccagcagttaaaacaacaagaaactattcaactgccacctaagaccttagcttttaaagaatgggctatgcttttgcaggaatatgggcaagctgaggcagtgcgatcgcaattacattactggttaaaacagccttggtctgaggtaaattccctaccagtagatgatcccacaggaaaacaaaacaactcagtagctagtgctgctaatgtatttgttactctcagtcaagaacaaacttgcgccctcttgcaacaagttccctctgcctataatacccaaattaacgaagtgctactgacagctttagtgcaaactttggcaaaatggacaggaaattccacagtactcattgacctagaagggcatggtcgagaagatatatttgcagatgtggatgtatctaggacagtaggctggttcacaagcatatttccagtaatattgcaactgcaaaatcaaaatcatttgggagaggctctcaaatcaattaaagaacagttgcgagctattcctcaacaaggcattagctatggaattttacgttatttgagtcaaaatcaagaaattagttttcaaatagccgcactaccattcagggaagttagttttaactacttgggtcaattcgaccagggacaattacgaggaattgattggaaattagctagtgaatctaaaggagctaatcaaagtctggaggggcatcgtactcatctattagaaattactgccagagtagtagaagggcagttgcaaattaactggagctacagtcgccacctccatcgacattctacagtagaatcactcgttcagaagtatctccaagctttgctcaaactaattgaccattgtctgtctcctgaagttgggggatacactccctctgattttccagtggcgaacttaaatcaacaggaactagacgaaattctcgcggaaattgactaaagaggatagaaacgacaatgttagttgaaaaatctcagaaaaacaaaaacgtagagtcaatttatcctctctcccccatgcaacaggggatgctctttcatagcatttatgctccagactcaggagtttattgcaatcaaacgctaatcactatctgtacagacattaacgttattgcttttaaacgagcttgggaacaagtcgtagaacgctactcggtgttgcggactctttttctctgggagaagcgtcaacaacctctacaagtagtgcgaaagcaggtggatttaccttggaactatcaagattggcgaaacctttcctccatagagcaacaacagcgtctagattctttactgcaaacagaatatcaagaaggatttcaactcaatcaagcacctttgatgcgctgtacattaattcggctatctgatcaaagctataaatttctttggaattggcatcatatcctgttagatggttggtgcttacccataatttataaagaagttttaaccttctatactgcttactctcaaggtcaaaactgctatcttccttctcctcgtccttatcaagactacattatttggttacagcagcaagacttatctgttgcggaaatgttttggcggcgcacccttaagggcttcactgctcctaccccactagtggtagaccgaccccagcttagtaactctggagtacaaccaacttatcaagaacaggaattgcatttatcccgcgctaccactaaaggattgcaatctttgggtttgcaatatggtctgactttatcaactttgatccaagcagcctgggctattctcctcagtcgctacagtggaagtggagagtctgaagttttatttggtgtcacagtttccggtcgtcctgccagtttgccgatggtagaaaacatggtggggttgtttattaataccttaccactgcgagtatccacccccaaatcagaattaattataccttggctacaacaattgcaacaaaagcaagcagaacttcaggagtacacttatagtactctggcagaagtacaaaacatgagtgatgtaccaccaggagttccgttatttgaaagcttggtagtgtttgagaactatcctatggatagcttgtcagaggagccaaatcaattattgccagtcagcaaggtggagaattttgaacagacaaactatcctttgaccgtagcagcaatacccaaacaagagttgctcataaaatttagttacgatactagtcgttttacaggcgacacaattgtgcggatggctggtcatttgcagaccttattaacagcgattgttgctaatccccagcagcagatagctgaactaccgttattgacacaagcagaacgacatcagttattggtagagtggaacgatactcagactgactatcctttagataaatgtatccatcaactatttgaagaacaagtagaacgcaaccccaatgcagttgcagtgatttttgaaggtcaacaattaacctatcaacaattaaatcaaaaagccaatcaattagctcactatttgcgaacaaaaggtgtagaaccagaagtattggtgggaatttttgttgagcgttcaatagagatgctaatcggactactgggaattttaaaggcagggggagcttatgtgcctttagaccctagttatccgagcgatcgcttaatttatatgctaactgatgcggcagtgtcaattttactaactcagcagtctctagtagactctttagaagcaaattcagccgaggtggtgtgtttagaccgtgattggcacatcattgctaattatagtcaacacaatcccgtcaaattggtgaaagcggaaaatttggcttatgtgatttatacctctggttctacaggtaagccaaagggagtgatgaatatccataaaggtatttgcaataatttattgcgaacaattgatacttatccgcttatcgcaggtgattgcatcctgcatataggtgttttaagttttgatgtttcagtctgggaaatcttctggtctttaacatctggcactactttagtagtggctaaacccgaaggtcacaaagatatagcttacctgattaatttaattgctcaacaacaagttactcaagtattttttgttccctcaatgttgcgaatttttctgcaacaaccaaacttagaaagttgtcgttgtttaaagcgagtctttagtggtgcagaaacactatcttatgaactaactcaacgattctttgagcgattggactgtgaattacataatctttatggcccaacagaagcagcagttgatgctacttgctggcagtgtcagccacaatctaattaccaggtaattcccattggtcgcccgatagctaatactcaaacttacatcctcgatcaatatttacaaccagttcccattggcattgctggagaattacatattgggggtgtacaattagctagaggctacctcaaccagccagaattaactaatgaaagattcatttctaatccttttggtgaaggtaaattatataaaactggagataaggcacgttatctaagtgatggaaatatagaatatcttggtcgcatcgatcatcaagttaaactacgaggtttacgtattgagttaggagaaatagaattccttttagacactcatccccaagtagaacaaacagttgtagttctgcaagcagatacttctgaaaaccaacgcttagtagcttatgtagttagaaaaaactcatcattgactcctagcgaactgcgtcgcttcctacagcagaaattgccagcttacatgataccttcagcttttgtggtcttgtcagaattaccattaaatcctaatggcaagatagaccgtcgaaaattgcctcaaccagatgaaacatcgatagtagaattaccatatttacctccccgcaattcctcagaaaggattttagtaagcatttggcagcaagttctgcaagtatcaaaggtgggagtgaatgataacttctttgatttaggaggacacagccttaaagcaattgctctagtcaatcagattcaagaaaaattgggtctttcttttcaaatcaaacaagtatttttgcatccgacaatagcagaacaagcagagttattaactgctagtacacctattaatgttcaggtaattccccatttatctaagcaagaaaattatgaaacatctcatgcacaaaaacgtttctttgtgttgcaacagatggatctaaacaatgtggcttatcatattgtgtctacactcaaaataaaaggaaattttgaccctgatgcctttgaaaaagcaatgcaagttttgattgctcgccatgaaacattgcggacatcgtttgtattaatcaacggtgaaccgaggcaaaaggtacttgcacatagtccttttcatgtgggatttcaagattggagcaatcaacctcatgctgaaagccacatcctagaaattattaaacaatcccaagaacctttcgatttagaaaatagcccacttttacgagctaatatttataagctcccagagcaacaatatattctgtgcatggaaatccatcatattatttgtgatggctggtcgatggatttattagctaaagaatgcttaaaatattacaattactttgttaaaggcttacagccaaatccagataaattgtctatacaatacaaagattatgcagcatggcaagctaatattttacgcagtgatgagtatagaaaaaacttagattactggcggcaaaaacttgataatgggcaaataccccgcattcacttacctacagattttcaacgaccttctattaagactttcaatggttcacatttaagctggacattcaaaccagaaatagtctgtgggttgcgagggatttgtcaacaaagagaaagcactttgtttatggcactattaacagcagtaaaagtattactgtatcgctacagtggtcaacacgatatttccattggtacagaaattgccactcgcaaccatcctcaactgcaatctttaatcggtttatttctgaatacactagttctgcgtgaccaaatagagccagaacaaggttataaaaatttgcttgcacaagttcgtcaaactgttaccgaagcatttgaacacgctgattacccgtttgatattttggtagaagaactagcaatttctaaagagattaaccgtacaccattgtttgatgtgttattacttctacaaaattttggtcaacctatagctatagaagaattacaaatcaaatccctaaattcactaactcctaccagtaaatttgacctgtcttttgtatttattgagcaaaacgagcaactcaggttagatttaatttacaatacagatttattccaagcggagaggatgcaaaaatgtctgagccatttcgataagttgcttaccgaaatgctaaacaatcctagccaaccaatctgtaaaatttctcttttatctccaacagaaaccgctttttttgaaagttttattcaaccaattcctcgcttagaaagacgcacagtaatccatgattttatcgagcaagtaagagctttaccagacaaaacatctattatttattctcagggagaattaagctatctggaattagatacacttactaactcttgggctaacatctttaaatatttaggcattcaaaaggataatatttgtggcgtaattcttgaaggagattatcgtcaagtattagcaatgttagcggtatttaaggctgggggaatttatttacctctgcgtttggatgaaccagaagaacgctctttacgcatgatgagcaaaacatcccccacgatgatagtagtcgattccgagaatttagatattatcaaacctcgattagcattattaccaaaaccacctcaaatattggtgataaatgcccatgaaattcagcaatactatcaatgggatggcacaaattatcaatgcttgcttgtagaagcaaatcatgataaaaaagttctaattatgcctgacgcagatgattctaactatattatgtttacctctggatcaacaggtgaacccaaagctatacttggtagtcacggcagtttgcgtcacttcatcaattgggaaaaattagaatttggaattaattctaattggcgctgtctccaaatcgcacaaattaattttgatgcttatcttagggaaactcttgtaactttatgttctggaggaactctttatattcctgatagcacagaccgcgaagatttagaaaagttattactgcggttaggagaatggcagattaacttactgcacactgttccttcggtgatgcgcctatttttaaagattggtcgcaatttaaccaatgctgatcaattactcaagaatttacgagttttggtattgggaggagaacctttatttgtcaaagaactgcgtgaatggcatcaagtttttggttctcagacagaatttgtcaatatttatggtgcaagtgaaaccacctttgtcaaacattttcatcggattcctgacccgaataaaattacttatgccagagttcctggaggtaaaacattgccagaggcggcgtttgcagtgattgatgggactcgtccttgtgctgtaggagaagtgggagaaattttcgtcaagtcaccttatttaacaaaaggctattaccaagaccaaagattaaccaattctgtttttatacccaatcctttgaatcatggggctgatatagtttattgcacaggagacttgggacgactgctaccggatttaacggtggaagtgataggacgcagtgataagcaagtgaagttgaatggagtacggattgagttgggagaaattgaagatgcactagctgctattgatggtgtagaaaaagcactggtaattgctgaggaaaaagaagaattagtgacagttattgcatattatcaggcaaagaatgctataaatcatcaacatattagcagccaattaaaacaagttttaccgatttatatgcagccaaatcatttgatgcagttggcagattttccgttattaccaaatggcaaaatcaatcgtctaggactaccaaaagcagaagcaaatattgctcaaacaagtcatcaaattactagctttaatccacaagaagctttattagcctccatttggactgaattattggaggtagaggtgagtgatactaatcagtcattttttgagctaggaggaaatagtttaaaggccatgcgcttagtgtcgcacatacgtaaccaattcggagttgcattgcgattgcgagaaatttttactcaaaacactttaaaagcacaagctgatttgattcaattacgacaagaaaaatgataaattcactaccgaatcaacaatattatgaagtatcccacgctcaaaggcggatgtggattctgcaccatataagtgaatattctagtgcttacaatattaggttggcaatgagaattaatggcagcttagatattgccgcattcacagcagcttttcaacaaattgtaaaccgccatgaaattttgcgtactacttttacaaatatcgcaggtagcattcagcaaattgtacatgaagaagtgcctaaagaacagttagtagtatttagagatttaagagaacaaaaggatgctgaaacaatagctgatagcttgattcaagaatcagcaaactcgcgttttgatttagagaaattacatttgatgcgagttttgttagtgcagataaagccagaggaatttttgtttggtttgactatacaccatattattggggatgcgcgatcgctcgacatcatttttcaagagttcgtcactttatactctgcttgcacgcaacaaaaaactgccgctttacctgcactaccattgcaatataaggattatacagcatggcaaaatcagtggttagaaagtgaggaggcaaaagaacaatgtaattattggtgcgatcgctttgctggagaaccacccatcctcaacttacctaccgactttcctagaccacaatttaaatcttctcaagctggtatatatacttataattttagtcagagtctaagcgaaaaattacgctcttttgctgctgggaatcatacaactttatttattaccctcttaactttatttaaaatattactccatcgctacaccggacagcatgatttagtcattggtatacctatttctggacgtaatcatccagacctagaaaatcaaattggcttttatgttaacactctagctttaagaactttactcccaaaagtgggaacttttcaacaagcattagcagaagtgacaaatacttgtcttgatgcttatgagtataatgaatatccttttgataaattagtatctgcccttgatttagaacatgatttaacacgaaatcctttatttgatgtgatgttttcactgcttagtaaagacagtaaagcagtgataaaaattcctgggattgaacatcaagcttacccactaaaacctcgaactgctcaattcgatttgagttggagtttatttgaagataccaacgatttaagattggttatagaatacgaaccggatctatttcgagaagagacgatcgctagaatgagcggtcactttttacaaattattcaggcagtagtcgagaatcctaattgccaattgtcacaaatcaatttactaacttctgaagaactttatcagttactaatagaatggaataacacagaagtcgcatatcctcaagataaatgtatccatgacctatttgaagaacaagtagaacgcaaccccaatgcagttgcagtgatttttgaaggtcaacaattaacctatcaacaattaaatcaaaaagccaatcaattagctcactatttgcgaacaaaaggtgtagaaccagaagtattggtgggaatttttgttgagcgttcaatagagatgctaatcggactactgggaattttaaaggcagggggagcttatgtgcctttagaccctagttatccgaatgatcgcttaatttatatgctaactgatgcggcagtgtcaattttactaacccagcagtctctagtatactctttacaagcaaattcagccgaggtggtgtgtttagaccgtgattggcacatcattgctaattatagtcaacacaatcccgtcaaattggtgaaagcggaaaatttggcttatgtgatttatacctctggttctacaggtaagccaaagggagtgatgattactcatcagggtatttgcaataacttattgcgaacaattgatacttatccgcttatcgcaggtgattgcatcctgcatataggtgttttaagttttgatgtttcagtctgggagatattttggtctttaacatctggcactactctagtagtggctaaacctgaaggtcataaagatatcgcttacttgattaatttgattgctcaacaacaagtcactcaagcatgttttgttccctcaatgttgcgaatttttctgcaacaaccaaacttagaaagttgtcgttatttaaagcgagtctttagtggtgcagaaacactatcttatgaactaactcaacgattctttgagcgattggactgtgaattacataatctttacgggccaacggaaacagcagttgatgccacttgctggcaatgtcagccagattctaactgtcgaataattcccattggtcgcccgatagctaatactcaaacttacatcctcgatcaatatttgcaaccagttcccattggcattgctggagaattacatattggaggtgtctctttagctagaggctacctcaatcaaccagaattaactaatgaaaaattcatttctaatccctttggtgaaggaaaattatataaaactggagatttagctcgttacctaagtgatggaaatatagaatatcttggtcgcatcgatcatcaagtcaaactacgaggtttacgtattgagttaggagaaattgaatttcttttagatactcatccccaagtagaacaaacagttgtcattctgcaagcaaatacttctgaaaaccaacgcttagtagcttatgtagttagaaaaaactcatcattgactcctagcgaactgcgtcgcttcctacagcagaaattgccagcttacatgataccttcagcttttgtagtcttgtcagaattaccattaaatcctaatggcaagatagaccgtcgaaaattgcctcaaccagatgaaacatcgatagtagaattaccatatttacctccccgcaattcctcagaaaggattttagtaagcatttggcagcaagttctgcaagtatcaaaggtgggagtgaatgataacttctttgatttaggtggtcactcattacaagccatgaatttgatggcattaatttatcaagaactagaaattgaaattcctttatcgatgatttatgaaaaaccaacagtagcagaattgagtaaatatatcatctacgctaaagagatgaatatccaacctaaagaacgtccttatatagtttttaatcaagcacgagaaaaagcagtttttatatttccgccagctcttggttttgccgcagcttacgcaaatttagctgattatttaacagattatgctatatatactttcagatatatagccgatgaagcaactttagaaaaatatgcagaattgatagacgacatagcaccaaatcaagacttaaaattgatgggacattcagcaggtggttttttggcaatgttgatggctcaaaagttagaaagtcgcgatcgcgtggtttctgatgtgattttaatagatacttatcgaggcggtcgtgaagctcaacaagctgaaatgtcagaaattatagaaggcgttgatactttcttgttaaatcccaaacgtcaggaattgaggcgttactttatggagaatcaaaaattacgcgatctcacctacaatcaagtctgggaatactttaattttctctggtattccgatttaaaaaatgtgcaaattaatggcaatattcatctcatccgtgctgaaggcaactacgattatgaagatgattggatacaagctacaaggggacaacgaatcaattattatgcccatggtgtccaccgagagataatcgatcccccctatctcaatcaaaacgccactattattaatgcgattcttagtcagaattgagaatctgaaaatttagaataagctgttacgcagctaaactgaataaacagcattacctttatttttaactttgcgctcccatttacagcacttccccttgttatgaggtacagtaacaacaattaggtgatttctgaaaaagaaattaccagctaaagaggttgaataaagatttcccatttgggtaaaagtggatttcgctgcaatctagattcgtatcggctcaataaataggggtaacagagaaaaataagtgcaacgaggtacacacagtgtcatagaataggaaacatgacgcaaaaaattattgagagtgacaaatcaatatcagatttactgcaaaccatcgagccaaaagggattgcagacgaatcaatgcgtcatacagtagaggtattactgaatctaatctgacgggatgacgaaatagtctaaaaagcttatcgtatacagattatacagatttatggtaaaaaagatagaagcacttttctcaataaggactatctattgataatgttacctgaattctacaaaacacacctaaaaaatcaattgaatctggcagagtatatcttgctcaaaattatgattattctgctgcaatcactgaaaaaagtaagtttagaagctttggctactgctctaccaattccgattaaatttgaaagtaggaaaagaaaaatacagagatttctatctttaccaaacctaacaattgagaaaatctggtttccgattgtaaaaacatttttagaaacatatttgaaggatgaagaattaatttatgtagtgatggataggacggcttggggacgcataaatttattcatgattagtatagtttgggatcaaagggcatttcctgtatattttgagttattgccaaagttaggcagcagtaactttgaggagcaatcacgaatattgaagaaaattttacccatttttaataactataaaatctgcggattaggtgatagagaattttgttctataaaactagcaaattggttaaaagaccagggcttatgcttttgtacaagacttaaaaagagtgaatttgtagaaatcaaaaaagaaatttgggtggatttaaataatctaggtttatcaccaggagttgctttctttttagccggagttaaagttacaaaaaaacatggttttacaagttttaatgttgcctgtaaatggaaacgcaagatattaggagtagccccaaaggaagggtggtttattttaactaatttagatagtttggaattagcaatttccgcctataagaagcgattttgtatagaagaaatgttccgtgattttagaagtggcggttataatttggaagacacaaaagttacaaataatcggttaatatctataattttattaatatcaattgcttatacgagtgccacaatacaagggcaagaaattaaacgcaaaggtatccagaaatatattggtcgagtgaaagaatatggacgtacagaaagaagacatagtagtttttatattggattatatgcccaatcttgggttaatttcatagataattgtagggaattagttaggtcaccattgagattatctcctaataagtggaagtattatcaacagggtgagagagctatgaggcttattctgtctgcatcttaa

SEQ ID NO: 73 - DNA, 36468 bp, Microcystis aeruginosa
aggaaacccgactacggctaaggtcagggtttctgtcgcttctccaaaattgttctgagcctcgacattgtagcatactaaccgacattctgcacatctccatatacttttacaaatttttacattccctgggatgttttgacaaaaaatcttcactgtagaaaccactgaacccaataaattagtaaaaattattaattgaatattaagaagtgcagaaagtgtgacatttaaagataaaattgcgcgaaaccagcagagcagagcttaggatgccacaccccataaacgtttattgcagatgtctattgacaattactaccttgatcaggtacgattagctgtctggtcgtaatagctgaaggggtgacaacgaggttgaagtttaagtgaggtgggggaaaaatttcctcactgtgagccatcaaattaatcgacttactcggcaaaaaccaaattccctcgttatcttttggcgaaagtctcaagctttttccctaaacccgacactctacaccctgtttcactttccatctgcttgtcaccccgtcagtcgcaataattattcttttccaagtcgattctaacactatggactttcaagataaaaagaacttatccgaaaacgaccaatcaatccaaactagagtttttaaagctcttagtgaagctaaagaaaaattaaaagctttcgagtctcaacaaagggaacccttagctatcgtgggtttaggttgtcgttttggtcataatattgcgacacctgaatccttctggtctttcctgaaagcgggtaaaaatcacctcagagcaatacctaaggagcgctggaaccagcaggatttttatgattcagatcggaataaagtgggtaaaatctatgtttctcagggggggtttctcgatgatgtctcccagtttgatgcccattttttcggaattgctcccaaggaagccgtcgctatggatcctcagcaaagattgcttttagaggtagcctatgaagctttggaaaatgcaggaatggcaacaacgacggctagaaggggcaaaacaggggtttttatcgggattactaacaatgactatgcccgtattcttacctcaaatgaggactataatgccatcggagcctatcatatttcgggcaatcatactaacgcggcagctgggcgtatttcttaccttttaaatcttaatggtccgagtttggcagtagataccgcttgctcttcctccttagtcgctgttcatctcgcttgccgttccttacgttcccaagaatgcagacaagctttagtcggaggagtgaacttagttttaactccagaagtggtcatcgccttgtgccgcaatcagatgttggccccagatggccaatgcaaaacctttgacgaaagtgccgatgggtttggaatcggcgaaggttgcggagtcatcctcttaaaaagactcagtgacgctcttgaagatggtgatcacatttgggcagtgattcgagggaccgcagtcaacaacgatggagccagtggcggctttaccgttcctaatgggcccgtacagagagaattaatcagagaagctctagctgacgctcgtttagatgccgaggctatcgattatgttgaagctcacggtacaggaacatctttgggagatcccatcgaaattaaagccatagccgaggcattatgcgtcaatcgtcgcaaatctaaccctttattagtcggttctctcaaaactaatttaggtcatctggcggcggcggcgggaatttcaggattaattaaaaccgcattatcgctacactaccgtgaaattccggctcatctaaaccttaaaaaaccaatccttcatattaattgggatgccttgccgattagtatcgttacgcaaaattgtccttggaatgttaataatggtaagctcaaagcggctggagtcagttcttttggagcatcaggaaccaacgctcatgttattttaagcgaaccacctcaaccgcaaccccaaaacccaaaaatatcacccattctcgttactttctcggctaaagaacccgaacgtttacgtctttttacgactcaatttgtcgatgagcttgagcagaaaacatatctcaacgtcaaggacattgctctatctttaaatactggtcgttttccccataaacatcgtctcgctcttttagtttctaatcaagagaatctgcgtcaaggaattcaggcttttctcaatagcaatggggatgaaaagcaatttcaaaatattcaaaataatagcttcgacatcatttatggagaagcgcaaagccatcctaaaattgcttttctctgcaattacgaggaagaaattagtccagaaatcattgaaaacctgcttaataatgagccagtatttcatgaggcttttaggcagtgcgagcatctgtttaaaaaatatttagaattttctcttcaggaattattgtcatctaaaaaagccttagagcctcagatttctttgtctgtacaaccggtattatttgcctatcagtatgctctttgtgaactctggaaatcgtggggaatttctccttctgcaattttaggttctggattaggggaatatctcgccgctcaacaagcgggcgttttttcccttgaagataccgtcaagctggtggcgaaacgcaccagaattagcccacaaaaccccaactcagaagaccttttatccttgctcaaaagcaccccagaagtcgattctaactcccccgatattaccctaatttatcagggtgaagttgtgaaaaaatctctcagaaatttggtgaatagaggggaaaagattaggcagaaatccgacgaaatcgcccaaggaatttctactctgcatcaaatgggatatcaaatcttcctagaaatgggaatcggtgccaatctcattaatataggtcgtcaaaagttaagggtaaattcaattctatggttatctagtttagggaaagattgtcacagtgaccagcatgagcaaagggttctaggtcaactctatgtgagaggatttaatattaactgggaagccttccatcgctcacatccagggcaaaaaattagtttacctaattcgccttttatccgcaaacgctactggataaattctggcaataaatcagagtcttctagctataaaaaccctaattattactctggacatcccttactaggcgatcgttttccttctcccttagctctccgtcaatatcgagggagcattagtcagcataaacctgcatttttaggagaacatcaggtttttgatcaggccatattgccagcatctgccttgatagaaatggctttagctgccggggagaatcaaagagttattttagaaaatgttgaatttaagaaggcattaattttaaaagatacggaagacgcattacagttaatcattgagcaaaaaagctttaaaatttaccatgaacttgagccaaattgggaaatattagttactggaaaaattgaggaattgaaatcaactaatttaacccattgtcatctagaagaaatcgccaaaaattgtcctgaagaagtcgatatcaactccttttatgaaacttatcaaaaatcagggataaattacgggagtaactttcggctcattcatcaactgaagcgcggagaaaatacagcttttgctcaaatcaaattaaccgatagattagagcgggaaaaatatcattttcatcctgctatgttggatgcttgttttcaaggtattgctgccattttatttaaagaagaatcctcagtaacttatgttcctgttcgtcttggtaaattggcatttttctaccctcctgatgagcaggtaatcagcgcggttcgactgaaaaactcctcccctaaccctaacattatcatcgctgatattgatatctattccccccaaggtcaacccttagcatccctcaccaacttagaactaaaagccgttcaatcccaagagattatcccccaagaaatcccccctcaaatctatctagaagaatggataccttgcgaggaattattagggaatggcagagacactttagtagctccccaggtgattaaaaatcaaattcaccccgcacagttagaacaacaactaggggaaaaattggcgcaatatgagcgcttaatggaagctttggaaaagttaagcgttgtctatatctgggaagccttaacaaaacttaatggacagccaaaattaggtcaaacttattccgaagcacagatagcaaatcaaggtcaaattgtcgatttttaccgacctttattatctcgatgtttaagcattttagctgaagaaaaaatcgttaatcagacaaaagatggctggttattcctcaaaaaattagaagcaccttcatcccaatcacaaattaaaattctccgccaagaatttgccgattatccagcagaaattagtctaatggagcgttgtggctctgctttagccgaagtcatgcgtcgtcaagttgatccattagaattactctttcctcaaggggatttagaagcgatcgcgtcaatttattcggaagcagccggagctaaattgatgaatcagttagtcgccaccacaatcagccgtgctattgagaatttacccccctattatcccctaagaattctcgaaattggaggaggcacaggagccgctactactggccttttacctcacttacccaaagaacatatcgaatatgtatttaccgatatttcctctagttttttaacaagagccaaggaaaattttagaaactatccctttattaaatatcaaactctagacattgaaaaaaatccctttactcaagattttctccctggcagttttgacataatcattgccgctaatgttcttcatgccacagccaaccttcaaaaaacccttgaaaatgtgcgctctctcatcgctcccaaaggactactaatcctcttagaaagtacaggggcaagacgttgggtagatttaacctttggcttgacagaaggatggtggttatgtagtcaagatctgcggcggaatggttatccgttaatcagcacaaaagattggcaaaatttactgattgagaatcaatttgaagacattaatattatcgaaccaagccaagtaaaaacccgaaatttattaaaccaaagtgtcattattggtagaagcagtgagcaattaccttctctgccagcaaaatcctactctcatcaaataatctgggcagatagtcaaggaattgctaacggtttaatccctctattccaacagagaggaataagttgttcttgcgtctttacccaagatattaacccagagattgctgaagattacctatcaatattgagaaactcgataacttcagaaactcgtcaaatactgtacttctggggcttagaaaaaatccctggagaaattgatcaacaagtcgagattcattgtcaacgatttctctttttcttacaagcattattgcagcaagaaaatccaccgactctgattttagtgactcaaggagcagtaccagcaaaagccattaaaaccctgatctctccctctcaagcatccttattaggaatagccttcagcctagttttagaacatcctgaacttaattttaaggcgattgacctagatccagatgaagtaaacgcagccgataaactgctgcaagaaatctacagtaatccccaagaaaaccggattgctttgcggggggaacagcgtttttatcctcgtttggtgcagagaaaacttgaagatggaaagatcaattttagtcctgatgcctattatttaatcacaggaggcacaggggggttaggattagcaacaacccgatggatgattgaaaaaggggcgcggaatctagttttgtgtagccgtcgaggggcagaaggaattagccctgaaatattagccaatttctcctctagtggggcagaaattaccctcaaaaaacttgatattaccgatgctgaaaaactgcacgccgtcctagaagaatgccgttctaaatatcctatacagggtatttttcacattgccggaaccttagacgatacaaccttattaagactaacaccagagagatttaattatgttttagctcccaaagttaaaggaacttggttgcttcatcaactcaccctaaatgacccattagaattctttgtctgttatacttctgctgtatctttaattggctcggcaggacaagctaatgctgcggcagctaatgccttggaagacgcttttatctattatcgtcaggcgcatcatttacccggaacggtcataaattggggtccttggagtgaaataggtgcagcagtagatcgcaatgttttggagagattagccgctaaaggatatggggctatgaaacccgatttagcccttaatgctctggaaaaaattcttctaaatcagattatccgcgctggtgtaattaagattgactggcaacaatttccttatattcatcaaagcttttataaaaactttctgcctcaaggaaaaacccaagctgccccctcatctgagtttttaaaacaatggcaaaatttaaccttaaaagagcgtcctaattggctaactaatcatatcatcatgcgtgtttctactgttttaggacgctcaaatgatgaaactttttcccctcaacagggcttttttgatttggggatggactctctcacttctacagagttacgaaatctgttacaaactgactttaattgttctctcccttcgacaattacttttcgttttccgaatgttgaagccttagctaattatttacagcaagaagttctagataattgtcaaccagtattgacccctcaaataaaagcagaaatttctcaaaaacagccagaaaaatcctctgtagaaaaatcacaactcgatgatgatcctattgttattgtcggcatggcttgtcgatttccaggcggtgctaagaatttacaatctttctgggaacttttggaacagggaaaagatgccataacagaaattcctcaagatcgctgggatcaggaaacatggtatgatcctaatcccgatgtccccggcaaaatatacgctccttacggtgcatttctagaacaaattgaggaatttgatggagaattttttggcattattcctagagaatctgtcgctatggatcctcagcagcgtttactcttggaaaccacctggcaagctttagaatctgctggacaaaatccccaaaaattacgcaacagtcagacgggagtttttatcggttgcatgactcaagattatgcccaattaagttattctcctcaagccattaatgcttatactggttcaggaacttctgttagtatggcggcgggtcgtctttcttatgtccttggtttacagggtccatcaatgactattgacaccgcttgttcctcctcattagtagcgattcatttagcttataatgccttacttaatggtgagtgcgatctggctttagccggaggggttaatattattttaactcccattatttctttaatcgaaagtcgcgctcatatgcttgcccctgatggacattgcaaaacctttgatgagagcgcaaatggcatggtgcgaggagaaggctgtggaatagttgttctgaaaagattgagccaagcaattaagaatggagaccaaattttggcgaaaatttatggtacagccgtcaatcatgatggtccaagtagtgggctaactgttcctaatggtcaagctcaagaaaaattattacatcaagcccttaaatgtgctaatctcaagcctgaacaaatcgattatatcgaagctcacggcactggaacagcccttggtgatccgattgaattagaaagtatgtccgccgtttttggtcaacgctcccctaatcggcccttaattattggttcagtaaaaacgaatttaggccatttagaaggtgctgccggaattgccggattaattaaaaccgttctagcgttacaacaccataaaatacctcctcatcttcactttaaaaatcctaatccccgctttgattggagttctcatatttttgaagttcctgtacaaggaaaaccttgggatatcagcgaacgtccaaggattgctggagtaagttcctttggatttagtggaacgaatgctcatatcattgttggggaaattgatgctgatttgcctcaagcttcggagaataatttttatctattacccctttcggctcgttctgaacaatccctgcaagagttagcgagaagttatcaagatattttgactgagtctatcaatttagctgatgtttgttttaccaccagtacagggcgggggatttttccgcaacgaatctgtattttagcagactcaataaccacggcacaacgagcattaattgattaccaagatggtgaaaattctgactcattaatccgaccgattttatcagagactccacaaaagatagctttcctcttttctggacaaggctctcaatattccggcatgggagaaaccctttataaccgagaagttgttttcaaggaaacattagatctttgtgatcaaattttagaaccccttttagaaaaatctctcttagatttaatctttcaagagcaaaatagtgagttattagaggaaacccaaatcactcagccggtgattttttcccttgaatatgcactcgccaaattatggcaatcttggggaatacaaccttcagcccttttaggacatagtattggggaatatgtggcggcttgttgggcaggagtcttttctttagaagatgccttaaaattagtgactcaacggggtaaattaatgggaaaattgccccagaatggcagtatgtccgctatttatgctgattatgagacggtagcaaacgctctaacttcttatgaaaatcaagttaatattgcttcagccaatggctcaattactgtcatttctggatttaaagagattgttgagcaactcgaaaaagaatttattgatcaagggcataaaactaaacgtttagcggtatctcatgcttttcattcgcctttaatgcagcccattcttgatgatttttcccaggtcttaaaaacaatttcttttcatgaacctagcttaacgattattagtaatctgacagggaaagctgtaggttcagaaattacaactcctgattattgggtagatcatctgcgtaatactgtacagtttagtcaaggatttcagtctttaattgatcagggttatcgttgttttctagaagtcggttctaagcctgtattactgagtatggctcgccttattgctgccaaccagtatctattatggttgcctagtattgtacccgggcaggatgaacaggcacaaatgtatagaagtttagcgacactttttgttaatggttattctgtagagtggactaaagtatttaaacaaggtaagcgaattagtttaccgacttatccctttcaaagagaacggtattggctatctaattcggaattttctctagggcaaatcaagactcagttacatcctttcattagagattttaaaaagttagcaacgggagacatgatctttgaaggtgaggtgagttctcttaaccctagttatttagaagaacacaaggtatttgaaaacattgtatttccagctaccggttttattgaagccattttagccgcaagtcagaaaatatttaatgggcattttgtcacccttgaaaatgtctctatccatcagggattaatcttatctccaactccctcaataatccaaataatttttaaacctaaaaaatcatctcaactgatttatacttttgagatatttagcagtgattctgcacaagaacaatggcttcttcatgttacaggtgaagtcaaacctaaggatatacaaagcttggctgcctcagaattaacccaaactaaattagaaagagaaaaccctaaggaatcgatttctatccgtgaattctatgagctttatcagcagatgggtatcaggtatggggagcagttccaagcgattcaagagttatattctttcaaaaaaggctctcaagctaaaattagtattaaccctagtttagcggatcggcgttattattttcatccagttcttttggatgcttgcttacagagtattggggcagctttccccgaaattcatggtcaagaattgcatctaccttatggattctcttccttggaaatattcctaaatccaacttcgcaagtttggacggaagttcaggtcatctcagatactaatggtgaaatgagagtaaatgttaatatttatgatgaacaaagacagctttgcgctcgctttactgacttaacagcacggcgcataaatccagctattttacagagtttatggcaagaacagtcaaataattgcttttataaagtggcatggaaaaaactttctttcatgccaactgttgccgtcgatcctcaaaattcttggttagtcttggttcgtccagaaacagacttaaattccctaattaatttatacaaaaaggcaggagaaaaagtaattactgtagaaatggggcagaattatcaatgttattctcaagattcttttgtgatcaatccggctcagaaatctgattttcagcgtctctatcaagaagcttatccatctggagaatttccgactggtgttgttttttgttgggaatcttcagaagctgaagacgtgctagatacagtatatcagagttctcatgccgtcttaaatttagtgcaaaccctcactaataactgggagaaattaccccatttatggctgattactcgcggggctaataagattagcaatgatacggctttatctcctcaacagtcccatttatggggattaggagcagtcattaatcaagagtatcctaaaatgggttgtgtttgtttagatttaccaatccataaagaagctaatgaagctgaacttttattcaatgaattaaagtgtttcccccatgaattccgtttagctttacgtcaaggaaaccgctacgcagccaggttagtttctgcatctcttcctatctcagaaaaacgacagtttattaatcagtcaggggcttatttaatcaccggagggggaggaaaactgggcggattagtggctcaatggttatcagaaatgggagcaagtcacctagttttgtgtagtcgccatgttaaatcttcaacagaattgatagccccattagtggagaaaggaacaaaagtaaccttgattgaagctgatattacttcccccacagatatgaaaaatttattctctcgttttggggcagacttgcccgtcttacgaggaataattcacgcagcagcggtcttagaagatgggcttatcagtaatcaaagttggcaaaaatatcaaaaggtaatcagtccaaaagtagcaggaactttattattagatcgttatactcgctctctatctttggactttttcgtaagcttttcttctgcggctgttatccttggttcgcctggtcaaagtaattatgccgcagctaatgctttcatggatgctctaatgcagcaacggcaaagtttaggattacctggtattagtattaattggggagcttgggagacgggcaaccaaattgatcaacaacgttttgctaattggggtttacagatgatgccctctgagcaagcgtttcaatatctcagtcaggtaattttaggtgatattactcaagggatagttctcgatattgattggtcgatttttaatcaaactttcaacattagtcaattcttctttagcgaggtattaaccctaaacaatcaaaaacaaacaagtccagcaaaactattagaacaattaaagtctgtctctatagatgaacgaataaccgctttagtagaaggactggagaaaatattaagagaagtgacagggttaaatgaaaataaggttattcctcaacaaacatcattcttagacttaggtttaaactctctaatggttatagaatttaaaaatcgcttagaaagagatttagggtgtaaattgccatcctcgatcattttcgattatcctaatcttctcagcttaagtatctatttaagggaagaaattctagccaatcatctcgattttgagattaaaataaatccaattcctgacaatcataatccctacgacagcctcagtgaagacgaactagcaagattacttaatcaaaaattaacggagcttgatcaatatggaggttaaactttaaaaataatttttcaaaagccatgagatgtggtaggataggtagatgaacatgagtaagcttaactctctggggttaaatttgggtttatatttactgatagcacagcatcctaatttatgtttaacggcgtataaatttagaaattatagagaatagggcatggttgagagtatagattacaaaaaattaatggcaacgaccttaagcaaaatggaggtcatgcaggctcgtatcaatgaattagaaacgagacaaagtgaatctattgcggtggttgggatggcttgtcgttttcctggaggtattaattccccagaaaagtattggagtttttgtcaagccgggcttgatgctatagtagaagtccctaaaagccgttgggatatctcaaaactgtattctcaagaaccaactttaggaaaaatgaacaccgcttatgggggatttcttcaagagaatatcacagaatttgatgctcgtttcttttcgatttcagcaaaagaagcagcctccatggatcctcaacaaaggttactcttagaagttgcttgggaagcgttagaaaatgccaatttacctctgaaaaatttagccgataataaagtaggggtatttgtggggattactagcattgatcatgccctgaaggtttacggtacaaactatgatcaaattgactctttttttggcagtggcaatgctctaagcgccgccgccggaaggctctcttattttctcaatcttcacggtccttgtctctccattgatgcagcctgtgcatcctcattagcagccgtccatcaggggattcgtagcctgagaaatcgtgaatgtgaactcgctttagtgggtggggtaaacctcattttagaacccgcaattacgattagtctttctcagtcgggaatgatgtcccccgatgggcgttgcaaaaccttcgatgcctctgctaacggatatgtgcgaggggaaggctgtggggttttaatcttaaaaactttatcagaagcccagaaaaacggggatcacattcttgccctgttgcgaggttcggcggtgaatcataatggggctgctgccggtttaaccgtacccagtggacccgcccagcaagaattgctccgtcaagctctagttgatgccagaatagtccctgaagatgtcagctacatagaagctcatggcacaggcacttctttaggagatcccatcgaattgaatgccattgcctcagtttatggaaagcgctccgaccctctttatgtcgcctcagtcaaaaccaatatcggtcatcttgaagccgcggctggcatggccggaataatcaaaacaattctgattcttcaacagggtgaaatcccctcccatcttcacttccaaacccctaatcctctgattaattgggaagaccatcctattaaaattcctactcaaaatataccttggccgaataacaataaagtccccatagctggggtaagttcttttggattttctggcacaaatgcccatgttattgttcaacaagcacccgtcagcaaaatctcagaaattcaacaacaacttcccagtcatctcttaaccctttcagcccacaacaaaaccgctttaaaagaattagccaaacgcttccataccctcctagaatctcgtcctgaaattggagatatttgttatagtgcagccgtcgggaggatagatttacctgaacgtttagccattgttggcgatacttgtccagaattacaacaaagattagccgcttttgctgaagaaaaaccacttgatgatttgactttttatcaacgttttacatcggaaaaatcccctaaaattgtttttctttttacagggcaaggggcttgttatcctggcatggggcatcaactatatcaaactcagccgacatttcgtcaatatattgatcaatgtgccgaaatattgtcgaagtatttagaccatcctttaactgaaatattatttggtgaacagaccgatttactcaatcaaactgcttacgctcaaccggctatattcgccctagaatattccctaacaatgctatggaaatcttggggaattacccccagtttactgattggccatagtgtgggagaatatgtagcagcttgtatcgcaggagtatttagcttagaagctggactcgccttagttgtcaagcgggggcaattaatgcaaaccacaacctccgggaaaatggcttcaatttttgctgatgaagagacagtaagttccctaattaaaaattatactcaaacagtttcaatagctgcaattaatcaccctcaacagattgttattgctggagaaagtgccagcattgaggaagttattagtacctgcaaaaagcaaaaaattcccgctcaatatcttcccgttactcaggcttttcattcccctttaatggagccaattttaaaagaatttgaaaaagaggctcgtcaaatttattatcaacgcccccaaattctgctactttcaggacttgatggagagcttttagaaaatgcaccagatgccgcttactggagtaaacaatgccgagaaccagtaagatttttgtcgagtttaataaccgctttcaacaagggatataacctatttttagaagtgggaccaagaccaatactagcagaacaaggtcgtcgttataaagatgaggtcatctggttaagttctctcaatcgtggcttagataactggcatacaattctttcagccttggcacaactctacctaaatggtgcacctttcaatccagaacaattcaatcgaaattatggctataaaaaagtcagattgccgaactatccctttcaaaggaaacctttccaatttcagcctaatcctcgaacggaaaatcagagcattgacaaaatattcctagacgcacaaacctctaaccttaccgataccgaaaccacagttttcaatatgcaaaaacatcaacaggaaatccgtaatcaattaaaatcaattttggctttacttctgaaagaagatgagaacgatctgccagaggatgagacattactaaacttaggagcagactcaattatcttgactgacttttctcgcaaagtcgaagaaaaatttcaagtcaaagtgaaaatagatcaactctttaccgatttacaaactcttgctgatattgccgaatacctctgccaatttgtcaacgaaaaacccttagaaaatgcttcagaaataacaactaaagttatcaatgatgagacagaattaagcaattatttgcaagtcattgagcaattgcaacccatcgctacagcctatatcatcagggccttagagtccttagggaaaaaacttaatcaaggggaacaatggacaatagaaaccctaagacaaaccttacctgttgctcgtaaatatcacattttgctcaatcgttatttgcaggatttagagcaagctaatgttcttcacaatcaagggaatatttggactgtcaaaaacttgcctgagtctttttccttaccccaagccctacaaaagctagaaaaaacttgtccatctgcaaaacctgaattagaaatgttgcaacgctgcggcgaaaatttagcggaagttctcaagggaaatatagaccccttgacattaattttcccagaaggttccgttgctcatgcagaaagtatttatggaaattctcccgtatctcgattgatgaatcaacgagtcgcccaagctattaaccagattttaaccaacttttctaatagtgatcgcccctatcaaattctcgaaataggaggaggaactggtgctacttcagaagcaattcttcaccacttaaacctcgatcatgtcacttattcttttagcgaagtttctcccttcttactgcatcaagctaggcaaaaatttcagaaaaaatataacctaaactttcatcaactagacattgaaaagtcccccatttctcaggggatacctgctcgtaattatcatattgttgtggccgctaacgtccttcatgcgactcgaaatattacagaaactctaacccatattcgggaactgctgcgccccggtggttacttagttctcctcgaaaccgtagaaaataactcatggctgaatttaacctttggattaacccccggatggtggcgctttcaggatcaacaattacgctcagatacacccttattaaggggtgaaaattggtgttccgttttaaaaagttgtgggtttgctacggcgaatagtttctctaaacaaaacaatattcccattaacaatggccaagaattaattcttgcttgtgtgccagatgaacccctctcaattcctgcaattcctaagttcactgtctctggtgaaagctccggtaaagaagccttaatgatggctcaattacaatctttaaaagacctaaaagacctccatgagaaaaccattatcaagcaattagaagttcttcaaactgcccctgttttccccagtatagcccccgaaatattaacgaatcagactcaaatcattcctacccaaagctctaagacagaaacttaccttccggtttctcaagagaagcccaaatctcctgagaaacctagttctcccaatttaaaccccttagctttaaagctgactgagaacaaatccttaaccgaacaacaacaagcctttattcaaaatttacagagtatttataaccagaaaaccgccaaatcaaaagcctattcacaaaatagccgtaagacaatggtggatgttaaaccgactattgacttccgcatggccttaaaagaatttcaatatcccattgtttcagaatctgctcaaggggcttattttaaggacattgatggcaataattatattgacttagctatggggtttggggttaacttttttgggcatagtcctgattttgtcattaaagcagttcaagaacaaatgaatcgaggaataggcttaggaatgcagtcaaatctggccgccgaaaccgccgctttaattagtgaaatgggccgagtcgaaagagtcgcttttagtaatacgggaaccgaggcgattatggcggctgttcgcattgctcgctcccggacaaaacgtcaaaaaatcgttatgtttgccggctcctatcatggaacttttgacggcatcttagcacgagtaggagaagataaaaccactgctcaacccttaagtctaggcacccctttaggaatggttgaagacataatagtcttgagttatggagttgaagaaagcctcgatattattgctactcatgctgatgatttagccgccgtattagtcgaaccagttcaaagtcgcaaacccgatttacagcctcaagaatttctgcaaaaactacgacaaataacccataaaaaagggatcacactcatttttgatgaaattattaccggctttcggattgctccgggaggagcgcaagaatggttcaatgttgaagctgatatagtcatttatggtaaggccattggaggaggtttaccaattagtatgatctgcggtaaagcagatttcttagataccgttgacggcggtttctggcaatacggagatgactctcatccccaaaccgagttaaccgcttttgggggaactttttgtcgtcatcctttagcccttgctgcttgtcgtgctgtgcttttacatcttcgggaaaacagtccaacgattcaagaaaaagtgaatcaattaactcatcgattagccaccgaagttaatcagttttttcaagaaataggcattccgattcgggttgttaattttggctctttattccgctttgaaccttttggagcttatagtatcttcttacaacccatcgaattacccctcttttattacctattaaatcttaaaggaatctacacatgggaaaaacgagtttgttttctctccacctgccatactaataaagatatagacaaagttatagtagccgtcaaagaagcgattacggaattacagcaagctggtttttttgctaatgctaaacgccctcaagtcaagaaagaagaaaaaaagcccctctctgaagatgaagatggtaggggacatctaccatctttaaatcagtcctttcccaccagtgaagctcaacgtcaactttggttattagctgaattagaccgtaatgcttcagcatcctataacgtcacaacatctctagaattactaggttctttagatgtttacattttagaaaaaacgattaatcaagttattaatcgccatgaagctttgcgaaccaaaattatagaacaaggagaattacaggaagttgtcaatgaagttaacattaaattaaacctcattgattttaaggatgaagataatcccgaagcgacggccttagcgttacgatctcagttttcccaaaaaccctttgacctgtcgattgctcctttatttgctgtgattttaatgcgcttaaaacctgaccattatctgctctctttaaaaactcatcatattgtggcagatggttggtcactaggattaattttgcaggaaattggtcaactttattcatcccaaaataacacaactaaagaggttctcacaccaccgatgcagtttcggcaatatttaaccttgcgagcgcaagagacgcaaagtccacaaatgttagagcatcgggatttttggttgaaaacctatcaggaagatctcccaacctttgagcttcccaccgactttccccgtcccgccgttaaaacctacactggcggacaagaaagtcaagtcattccctctgaagttgggcaaaatttgcagaaagtaggacgcaaaaataaagctacattatttatgacgatgttcgccgcttatactgcttttttgcgtcgaatttctggccatagggatttagtcattggtattcctatttctgggcgacaaatagaaggtagtgacaacttagtaggcttttgttctcaatttttacccctgcggatacaagtcgatgctaccacctcttttattgaacatttacaacacactaaacaaaccctgatcgacgcttttcgccatcagagttatactttagaggatttattagcagctttacaattacctagagatttttctcgttctcctctcatttcggtatcttttaacatggatcctagtttaactctgcctgaatttaaagacttaaaagtatccttgccaccgtcaccgattggttatacaccttttgatctaggatttaacttaattgaacttaatgataacctcattatttactgcaattacaatacagaactctttaaaaaagagacaattaaacaatttattgaaagctttgaaattttgctgaggggaatcattgacgatgctaatcatcttctttatcagttacctttattaaccccagtccaacaagagaagttactcagacaattaaccggaaaaactcgcaaactccctgagaaagccaccatcattgatgactttgtagctcaagttaaattaacccctaatgctcccgccttaattgcaggaaaaattaaccttagctatcaagaattaaatgaaaaagtcaatcgtcttacccattatttacagcaggaatatcagctaggtgtaggaaaagtgattggggtcatgctccagcgtgatcacaacttaatcatcgggattctggctacctttaaaactggagcgacttacgttcctatagactctcaatatcctcacagtcgcattgagtttattttaaaagatagtggctgtcatgtttgcctaacggagagtaattttatctctaagttacctgaaaaaatgcagaaaatttgcttagataaaattgatcctattgttgaaaaatatgacaaagatgagcctaaaatatttcgcaattctagccaaactgcttatattttctatacttcaggttcaactggtaatcctaaaggagtcatgggctgtcacatctcaattttgaatgttattcaaagcttacgacttacttttgatttagataaacatcctgaatggcgctatattttcacagctgccgttactcatgatccatctattcgtaatatttttctccccttaaccataggtgcatccctatatatgtacgaaataaaatatataggacatttggtttctttcctacaagaaaatcaaattaatgccctacatactaccccctctatctatcgagaaatcttagggctacttgaaccgggagaaaccatttccagcttaaaatatatctcggtaggaggggaaaaattagatcgggaaactgccttagctttacggaaacgttttccggcagaaattgttagcaatgtctacggatctacagaaacttgtgtaggagtatcccagtatgaaatcaaggaaaacttagacagcgaaatccccctcggtcaagttttccataacaatcgcttaggggttcttgatgaatttaataatcccgttcccctccatgtaatcggcgaaatttgtgtagaaggtgccgccctagcatcgggttatcataaccaacccgaaatgactcaagaaaaatttaaacctagctttcttgatgagacaaaaactctctttagaaccggcgatttaggcaagcaaactgctccgggtatcattgagtttatgggacgaaaagataatcaagttaaggtcaatggttatcgaattgaccccggagaaattgaatatcaattgactcgttatgctcccattgaaagagcgattgttttacccgttcaagttaataatcaaactcaattatctgcttactgtcaaacagacaaaactctagaaattgctgagattcgagaattacttgccaaatttttaccagtttatatgattccgagttactttatttttttaaagcaattccccttaactcgacatggaaaacttgacctgcactccctgagagaactcagagaaactggtaaatctctggtgaattctaattacgttgcaccccgtaatcatttagaatccaatctcgttagtatctgggaaaaaattctctctaaacatcctatcggtatttttgataacttctttgaaattggcggtcattctctactcttatcaagggttgtaacccgggttcataaagaactaaatgtatccgtaaaattggctgacttctttaaagttccaaccattgctggattggcgactttaatctcccagactcaatacaattatcaagaacccatttcggcaattcccccccaaaaatcctatccgatgtctcatggtcagcgtcgtctttgggctttagaattcctagatcaaaatcataatgcctacggaatgcccagtgcttatcaattcaagggcaatctcaatattgatgcttttgaaaatgcctttcaacagttaattcaacgccatgaaattttgcggacaacctttactttaatcaataatcaaccccgtcaagttgtccataatcaaatgaactttgtcattaaacaaatagacctgacagcttatgttagcacagaacaagaaaacctgatcgaagaatcaatcagccataatgccaaaacgacttttgatttagaagtgggaccgttacttaaagttaacttacttaaactaagtcaagagaattacatcgtcttgtttaatatgcaccatatcatttttgatggttggtcagcaggggttttaattaaagattttctcacccattatcacgcctatggacaagaaaattcccaattaatgccccctcttagaattcattataaagactatacttcttggcaagaaagtcaattagagaccttgaaacttcaaggtcaacgggattactggttagctaaattaactccagttcctgttcgtcttaacttacctgttgattatccgcgcccacctgttaaaagttttcagggaaatacaattacatggcaacctgaacccgaattgatcgatacttttgagaagttagttaaagcacaagaagccagtttatttatgggtttagttagtttggttaagagttttctattccgttatactgagcaaaatgaaattacaataggctctgctatcgctggcagaaatcatcctgatttagaagatcaaatcggattttatgttaacactctcgtcctgcgggatcagataacagatcacgacagttttacggatgtccttagcaaagtaaaaacaaccactttagaggcttatgatcatcaagactatccctttgatcagatcgtatctgatttgaatttacaacgagatcctagccgtaatgctctctttgatgttgcaatcgttctgcaaaataatcaaaatgtagatctggccttggacggaattacagttaactccattgacccaaaaatgattaccgctaaatttgatttagaatttatctttgttgaggaagaagaactttatctcaagctaatctacaacacagatatatttatccatgagcgaattttattgatcatagatttgttcaaaaactggctagagcaagttttaaaatttgcccatgaacctttgataaacttatccttagcttcctcagaaaatcttactcaagaggggcaggaactgttcacagaagactttaatttttagtcaatagccattacactagcaggagattttaatgaagacaaaactaccgattcttggcgttttaggtggtatgggaccagtggttaccgccgaatttctgaaatcgatttatgaatataatccttttattgataaggaacaagaagcccctaatgttatcgttttttcccttccctctgcacctgatcgcacaggttctattgatagtggaaaagaaagagaatttattgattttattcaagtcaatctggaacatctcaataaactggctgattgcatagtcattggctgttgtacggctcattatgctctgcctcagatttccgaaaatctgaaggataaacttatttccttaattaaaatagcggaccaagaactccaagaatataataaacctacccttttacttgctagtacagggacttaccagaaaaaattatttcatgaaggctgcaccaccgcagatctgattatttctctctcagaaagtgatcaaaagttgattcatgaaatgatctataaagtgctaaaaagaggacaggatccgttaagtattcttagggatatagaagcattattagagaaatataacagtcgctcctatatttctgggtgtaccgaatttcatctcttaacaaaatctctcaaactcaaaggaattgactccattaaagcgatcgatcctttaagtactatcgctcaaaacttttctcagttaatcatcaaacaagctcaggtagatctagtgaccgactgccatcagccttcaaacccaaaaagcccttgaccatcgcacctctatcaggtataattcaaacttgagttgatcacttctgacttttaacttgtgggtagcgatatactggttcatcaggttttcaagattattcctatttttgataaagaggtgtaaaaaaaatgtctaagcattccatcagttttggaggacaattggaagataattggcggactctgtcagaagtattagaaactgccactaaacataataatcatggaattacttatatcagaaatgacgcaactgaatattttcagagttatcaagacttatatcaagatgctttggttattttaaatggactggaacaaaaaggaataaaattagggcataaagtcattctacaaattgccaaaaatcaagactttattcccgcactatgggcttgttttttagggggaattattccagttcctttgaccgttgctcctagctatgatctggaaaattctgccgtcaaaaaactagagaatgtttggaaaattttagacaatcccttgatattatccgacagtgagctaattactgaaattgaaaaattaggaacttactctcacttagaagggtggcaagttatctcagttaatgaactcagaaaagcaccctctaaaatcgaacaattgccgattcttgacccacaagatgcagccttattactctttacttcgggtagtaccggtatgccgaagggagtaatattaactcatcataatattctgtccatgactgctggtacagtggtgatgaaccactttacccaacaagaagttacccttaattggatgcccttggatcatgtaggagctatcgtatttttaggaattatggcggtagatttggcttgtgatcaaattcatgttcccatggaattagtcctacgccaacctctgcaatggttagaactcattcaaaagcatcaagtaagcatttcttggtctcctaactttgcattttccttaattaatcaacaggccgaagaacttaagcacgtctcttataacctctcctcaatgaaatttttagtgaatgctggcgagcaagtttcagtaaaaacgattcgcctattcttagaaattcttgaaaaacatcaactacaggagagagcgattaaaccggcctttggcatgactgaatcctgttctgggattacttggtcagccggtttaagtaaaaatgaactcaccgaagaaaatagttttgtctctctaggaaagccgattccgggagcaactatccggatagtcgatcaggaaaataatcctttacctgaaagagaaattggcaggcttcaaattcaaggtaattctgttactaaaggatattataataataatgaactcaaccaggaagtttttcaagaagggtggtttactactggagatttggggtatttatctaagggcgaactctttattactgggagagaaaaacaagaaattataattaatggtgttaattactttgcccatgaacttgaaacaacaatcgaagaattagaaggagttaaagtctcttatacagccgcctttgccgtctttgatcaaagtcgagaaactgatttattaattattacttttagcccagaatctgagcaatttgaacagggaataaaagttgttagaaaaattcgcagtcatgtaacacaaaaattcgggattgctccagcttatgtcattcccttagaaagaaatttagttcctaaaacctctattggcaaagttcaaaaatctaaattaaaaaaggattttgaacagggattatttagcagccgtatccaagaaatagatcaatatttagcaaaagagcgtcagaaaaatcaaaccttacctcaatcagaaaatgaacggcaaatagcggcggtttggagtgaagttttacagttaacctcagttggtttagaagataacttctttgaactagggggacattctatacacttaatccgagttcaaaatgaacttgaaaaactttttaaccgtcagctatcccttgctgaaatgtttaaaaatcctaccgttgccaccctagcccgtttcttaagcgaagaatcaaatactaatcaagttatagcacaaaaaagccgtcaacgtgccgaaaatcggagccgtcgccataatgaaacccatgacattgcaattattggtatggcggggcaattcccgggggctaaaaatttaacaaccttctgggaaaatttaaaaaatggaatcgaaactatctctttcttttctgaagaagaattacaagaatcgggagtgtcttcggaactatttaatcagcctaattatgttagagctagaccaattctcgagcaagttgaatactttgacagcgaattttttggctatacagatagagaggcagaattactagatcctcagcaacgtttactgcttgaatgtagttgggaatgtttagaaaacgctggttataatcctaatacttatcaaggatcaattggtatatttgcgggcgcaagtatgaacacatatctgataaataattgttatcctaatcggggtaaattagatactaatgacgagttacaacccttcacactagattcaatgggagggtttcaaacaatggtagctaatgacaaagactatttaacaacgcgaatttcttataaactcaacttacatggtccgagcgttaatgttcaaactgcttgctctactggattagttgtagttcatctcgcttgtcagagtctaatcagtggagaaagtgatatggctttagctggagctgcttcaattaattctcctcaaaaaattggttatttatatcaagaaggactgattatgtctcctgatggccattgtcgcgcctttgatgctgaagcaaaagggactatttttggcagtggagtaggagtaattatgctcaaaagattgtcagatgctttagccgatcatgaccatatttatgcagttattaaaggctctgctattaataatgatggtggtcaaaagttaggatttactgcccccggtggagagggtcaaattgctgccgctacggaagccctagcctttgccggtgttgatgctaatacaattagttttgtggaagctcatggcacaggaaccccccttggagatcccatagaagttgatgctttagctaaagtttatcagggtgcaaatgagggagaatgtgttttaggttcagtaaaaaccaatatcggacatatgcagattgcttctggtattgctggtttaatgaaagcgactttgtccctcaaatataagattattccacctacattacatttccaaaatcctaaccctcaaattaatttttcccagactcctttttacattaataatgaggctatttcttggactactaagcaagacaagtccgaaaaattaccccgacgggcaggggtaaactccttaggtattggcggggttaatgcccatgttattctagaagaagctcctcccattattcctcaagacaatcagagccaacgtccctatcatttgctcaccctttccgctcgaaccgaaccagctttaacagagttagtaagtcgctacatagactttttagaaagtcaacctgaaaaggatctatctgatgtagtatttacggcgaatacgggccgagttcatttctcaaatcgtttagccttaactggctataaaaatagtgattttattgaacaattacggcagtttaagcatctcgattatgagtcaactatttatggtatagttgatgaaaaaagaccgtctaagattgcctttttatttacagggcaaggttctcaatatgcggggatggctcatcaactctatcagactcaacccacctttagaaaaactttagacgcaggggaaaaatactatcaaaaactaacgggtaaatccctactaaacgtcgtatttgctgatacagatgacgccttaaaccaaaccgattatacccaaccggcactatttctgattgaagttgctctcgctcaattatggcattcttggggaattcaaccagccgctattttaggccatagtttaggagaatattcagctgcttgttttgctggtgtttttgatcttgaaagtggcttaaaactggtcagccatcgaggcaacttgatggggcaattaccccaaaatcaaggggaaatggcggctatttttctcgataagaactcagttattgagcattgccaaagtcagggaataaaaatcgctattgctgccattaacgcggaacagcataccgttatttctggagaaaaaaacgtaattcaaaaactctgtaaccattttactaatgctggggttaaagttcgtaaacttaaagtttctcatgcttttcactcccctttagtagaaccaatggttgcagaatttaaaacgattcttcaagagatttctttcagtcaacctcaaatttctctggtctctaacctaacgggagaaattgctgatgacagcattatgactcctgaatattggcttcaacatttactaaatacggtacaatttcatcaaggagctttattcctacaatctcttggatgtgatacctttattgaaattggacctcaacctattctctcaggaattattcaatcatctctatcttcatctgaacctctaactctacccagtttacgatcgggattttctgattggcaagttttactagaaagtctgggtaaactctatgttcgcggtgcaaagatagactggtttagttttgatcaagactatcatcctagacgatgtgctttacctacttatccctttcaaaaacgtcaacactggattcctttaaaaaccccatctgcaactgttccacaggaatctaatctggtcaaaatgttatccgaaaaggacaaaactactttaatgcaaaccatcttagaaacaggtcattattctgaagatgaaaaaccaacaatatctgccattgttcaacagttgattaaactgtattatcaagaaaaagaggactttgattttgccaaattactttatcaagtagcttggcttccctgtgatttagctaacggtaagctagaaaatctgaccagccttaaaacggatttagaggtttacttagaaccccaattacaatcctcagaattgatgggagtttctctcgctttttctgaaatggaaaaactggcggctgactttgttgttaaagctctgaaagatttagaactctttcaaatgaatacctttcttgatcccgatcaaagttttattcaagctggactcaaacaagaatataaatatttctggaattatgttatagaaatattagcgaaagtaggcattttagaaaagcaaaatacccgatggaaaattgttaaagaacctgaacaatctaatcctgatttagcggtagaagatttaatcaatcattatcctaatgctcaaatagaactccatctatttcgacaagttgccacaaatttagcggccattattacgggaaaaatatctcctttatctatcctattttctcaagatggacaaggaggagccagcgaattttataaaaatacatcttcggcaaaaattctcaatctgggtatctctaaaaccgttgaacttctactctcaagttatcctccctcagcctccctccgcattctcgaaattggtgcgggaactggagctacaacccaacaggttcttaaagcttgtaactctcgtcaaattacctacacatttactgatgtttcccccttctttctagagaaagctagagataatttggctgaattttctggactagaatacaaagttctcgatattgaaaaagacccgaaattacaagggttttgctgtcattcttatgacttgattatcgcagctaatgtcttacactctaccgccaatttacaagaggaaaccttgcctcatattcaaagtttactacgtccaggcggtcatttattactgttagaattaactcagcaatcttcctggattgatttaatctttggtgtcactcaagggtggtggcgttttagcgattatcatttgcgcccaaatcatcctataattacagcatctacttgggaatctatgctgcttaaatcgggtttttctcaggtggaatttgtttctcctgatcaaaaaataggtactgctttatttcagcaaagtattattctggctcaaagtttagaaatctcccctaacaccgctaaaaactggctaatttttactgatattgaaccccaacaaaatacttttgccttagggattcaagagcaactacttaaaaagtgtgattcctgtcggataatttatcaaggggagaaaaatacacaaatatcatcttctgagtcttgtttgaatgctaatcaactacaacaattagaggaatggtttgcgtcaaatccatctccagatcggattatttatcttttgaatagtgatggcaaagatcaaccagaatccattttattgaatcgctgtaactatcttttaaatcttctcaaagctattcaaaaaatccctaatccccctcaattattccttgttactcagggggcccaaccctttgaattagaacagccttctttggggtttcagtctcctctttgggcaatggggcgtgttattgccctagaaaatccgcaattatggggaggtatgctcgatcttgatcccgacgttgacattaatcaaaatattaccgcattactattaggattaactcatgctcacgatgaggatcatttggtcttccgcaaaggtcaaggctatgttgctcgtctgcttcctctgaagtctctagagacaaaaactgttaagattcaacctgaggctacctacctaattacgggaggaataggacatctaggcttagaattggcggaacatttagtcaatttaggagcaaaacatctcattttaacgacacgccgctcattaccagtccgcttcctgtgggattcagcagccgaattagctcaaatatcagaaaaaatcagaaaattagaggaaaaaggagcatcaatcgcagttatttcggcagatgttggcaattttgaggctatgcaggccatatttacccaaattgaaaaaaccgcttatcccctgcgtggcattttccatcttgccggaatctcaggccgacaagctcaattaaaagactgtactctgcaggatctggaagcagtttttcaggcaaaagttaagggttcttggaatttacatcaactatctttgggtagtcaattagactattttgtgctgttttcttcggcgggtgcaatttggggggcaaaggaacaaggcttatatgatactgttagtcattggctggatgctttggctcatttccgtcatcttcaagggctgcctgcaacgactttaaattgggcattattggcgggtcatggtatagtatctcaagactatgaggactggctcaaacagattgggatcagggaaattgctccagatatggccttgagagtgatggatgctattatggcttctaatcaaacacaggttttaatcgccgatgtggattgggttcgtttcaaaaatatctatgaatttaaaggtgagaaaccactcctaaaaaatttaggactctcagaagttgccattaagtctgttcaagaatcagactctgtactgcatcttttagaggagatgcctttcggagaacgtcgggaatatttgttagaatatgttagcaaacaagtcagaattattttagggattaaatctatgccagatacagaacaaggattgatagaaatggggattgactccctatcctctattgaattgaaaaatcgtttagagaaaagattagaagttctcttacccacttctttagtctttgatttccctaatattagacgcttagttgattatctgcttgaccgcattttcggtgaaaaagttcaaaaaacagccgagaaaaagatgattaacttcactgaagttcagcaggagattagtgaggatttaatcttacaagaacttactgatttagaggcttttttaggagattaaataatcctaatccttgaagttagaaagcttgaaattaaaaaaaattcaaggcatttcctaaaagttaacctatattaaaactatgcaaactacattttttcaacaagaaaccgtaaaaagctctcatcaattttttgacaatctgaaattgattgccggtccttactggtatccaactgatcctaaagaaggaagaaaattttccgaggtaataagttcatggggaatgctgtttctcctccttttagtaattgttggactggttgcctctaatgcagttaatagcttcgttaatcgctatttagttgatgttattattcaagataaaaatgcctctaagtttctgacaattctattattttatggcttaggattacttttaattaccctgtttactgcattttctaaatttgttaaaaaaagaattattctggattggtatgaatggctaaatcagcaggttattacccaatatttgagcgatcgcgcctattataaaattaattttagatccgatgtggataatccagatcaaaggatagctcaagaaatagaacccattgctagaaatgctgttaattttggctctgttttattagaaaaagtcttagaaatgacgacttttttagtaattcttttttcgatttcccgactagccgccttgattttagtggcttatacaattgtcggcaacctaattgctgtttatttaagtcgagaattagataagattagtcaagaagaattggaatccaaagctaattacacctacactttaactcatgttcggaatcatgctgaatctattgccttttttcaaggcgaaaatcaagagttgaaaatcattcaacgtcgatttaataatctcgtcagaaattctctcagtaagattgattgggagaaaaatcaagacatttttagtcgaggttatcgttcagttattcaaatatttccctttgttgtcttcgctccagcctatattcggggggaaattgatttcggacaagttaatcaggctattattgcttgcagtatgtttgctaatggtttttctgagttaatccttgaatttggttctttgggcagattttccagttatgttgagcgtctatctgaattttcgtcggccttagaagaaatcggccaacaaaccaaggatgctagtaccattaaaacccttgaacaaaatcagatcaagtttgaggatgttactttacaaacaccggattatgaaaagctaattgttcaacatttatccctatctatcgaaccaggcgaaggtttattaattgtcggaccgagtggacgaggtaaaagttctctattaagagctattgctggcttatggaatgcaggaactggttgtttaaaacgacctcccttagaacaatttctctttttacctcaacgtccttatattattttaggaactctcagagaacagttactttatcctaaaacaacccgtgaaatgaccgatggagaacttgaatcggttttacaacaagttaatcttcaaaatatagccacaaaagttcatggctttgatgcggaagttccttgggaaaatatactatctttaggagaacaacaacgccttgcttttgcccgattgttagtaacccatccccgctatgtaatcttagatgaagccacaagtgccttagatttgaacaacgaacaaaccttatatcagcagttacaaaaagcacagacaacttttattagcgtaggacatagagaaagtttatttaagtatcatcaatgggtcttagaacttttagaggattctagttggcgacttctttccatagatgattatcgagcctcaaaagctctgtaactgtttcattgctaaacctcaatttaggaaaaattacgatgactactacttcaccaaaaactctgactatggatattcaaaaacccagggttcttttaatcggaaaaatgtatgatgaagcggggcaaaaacttcttgaagaatctactaatatagaaattttgtccaaccctacactggaggaaattaatgaggccattcaagaagtatctggcgtatttgtgcgttatcctaataagttagaggcttcatcaatccgattagcaaaacaattaaaagtaattagtacctctggatttggcacagattctattgatattatggcagcaacagaacagggggttatcgttgttaataatcccggaatgtcaactacatctgtagcagaacacaccttatctatgattttagcccttgctaaaaagctcccttttttagatcattgtgtgaaaaagggtaactatttaattcgcaatcagatgcaaccgattcaactcgaaaacaagacccttggtattgtaggtttaggaagaattggtactctggtggctcacaaatgtaacctagcactggggatgagagtattagcttatgatccctatgttccagccagcaaagcggagacagtaggagcaacttgggtcaaagatttagatgttcttctggctgaatcggactttgtttctttgcatactgaactaacaagtgaaacgcgggaaatgtttaatatatcagtttttaaaaagatgaaaccaacagcttttttaattaatacctcccggggaaaagtcgtttgtgaaaaggatttagggatcgcccttaatcaaaaattgatagctggatgcgccctcgatgtctttgaaccagaaccgccggctttagataatcctttatataattttgagaatgtcattctctcacctcatttagccggagtaacccctgaagcgagtctagcggctgctgtttcggcggcgaatcaaatattacaagtgcttcagggagagaagcctccttatatgattaatccagaggtgtggaatcttttttaaagtatctagagaatctcagggattcggttaattaaaaatggcaatatttctgcaaaatccttaggaggataataatttggaaaacatcggcaaaattcccctcaaagatgaatggcgtaatcgctgggcaaccatcaaacaatttatccttaatccggttcgagaaatggcgtttttgcaagatcagtttcaagtttctgaactgtatactaatatagcgaaacgcgatcctcatcttcaggatcctaattttccccaatggcttaattttggttattggaaagaagaaacaacttataacggagcttgtgccgctttagcgcgtaaattagccgaagtagccgaacttaaagccggagatcaccttttagatgtgggtttcggttttgctgaacaggatttactctgggtaagagaaaacaatgttagctcaattattggtctaaatacaactgagttacaagtagaaattgctcaagaaagagtagctaaagcagggttatcggacaggataaaacttcaagtcggctcggctactcaaatcccctttcatgagaattcttttgataagttgaccgctttagaatgtgcttttcattttgacactcgtgaggatttttttgcagaagcttttcgagttttgcagcccggtggaaggttggctatagcggattgtttgcctagagtgggtcgagaaattaacttctggctgcgggttaatagtaagaaaatgtgtattccctttcctaatcaatacgaccgacatacttatgtagaaaaactcaaaaagcatggatttgttaatatccaagctttatctattagtgaatatgtttggccggcaatggttcattattttgcccagattagccaaggaattagtaagcatgatttagttatcgatctccagaaagataacccaggactcgaagcttggtcaagaaatcggggttggtttatggcgtttgatgattatcttttgttttcggcagaaaagcctaaattaaactgagttcggtttaagcagattgaggtaaaacccagtccatagataggggggacttcttgttagcgattgcctattaatcaaggagttgagaatctagaattggccaaggttttctaacagtcccttctatagcgttatcccgaacgcaggttaagctagaaatcgctagtcaccccccagatgtagggctgattcattctctcttatgtcattctctcaactccttatctggtaacgtttttagtcgatttctcggaaatacatagctgaaaatttgtcaaaacgtcgtgctttgtaggttgattcatgaatcaacctactatgagagcaaaaaccggtactcccctgctccctaacttacctcgtaagcgattaaaggtagcaaaaaaaagaagtagattcggagaatgaattagccctagtattaaggagggatcgacaccccccttatcaaggggggattaaggggggatcgaacccaaaatctatcttcaatttaattataaccagctacttacaatcaaaaatgggataggttaaaaacagatcccacggttccgattaagtcagaattactgacgaatttgtaccggcatcaccaaataggtcatctttaaacctcccaagggggtaaaaataaccggttgggtactagcatttaactgcatttggatatcattattgggtaaagccttcaaaccgtccatcaaatatttaacattaaaggcaatatcgccgctttctccctgaatttccgccgccatggactctttagcactacctaaatcgggagactccaccgcta

SEQ ID NO: 74 - DNA, 65820 bp, Nostoc sp. 152
gcgaatgatcagcttgacataacaggcaggagttgatggttgtccatgttgatgccttcttggacggatttagcggatatgagcaatccttagaagaagttactctcagaattagagaatggtcattactagcacctgagactattgcaccgcgaatttgggatgctaccgcagcaatggcagaccggatggcttactgggcagacaaaaactggaaaattgaaacagaatctgatttggatcgttacacctttggagttgcaggtgcagttgggttattactctccgatttatggacttggtatgatgggacgcaaaccaaccggactcaggcaattgggtttggtagaggcttgcaggcagtgaatattctacgtaatcacattgaagatttagggcgcggggtagaattttttcctgaaggttggagtgtagaaaatatgcaggagtatgcactccgcaatctagcgttagcagatgcctacacccatgctttacctgttggccctgcccttagcttctgccaaattcctttggctttagctcatggcactattgatgctctcgctaacggtaaggaaaaactcagccgtagtgatgtgattgcactactagaaaaactaagtagtgtgaacgtcaaagctagctaataattttagcaaataagggacttccaattaaaaaatacccaaaattttgattgggataattgattttttggtattcccttaaattgattgatattgcagaattgggatgaagtgaactatcagttaaaatacatttaaatttgatcatcactcataatattattcattttccataaatcatttgtatttaaaaaagacaaatgacaaatgacaaataaaacagagatatcagtgaaaaaaactttgttcctcaatcctccttcctttgatgggtttgacggtggcgctggttcacgatatcaggccaagcgtgaaattacatctttttggtatcccacatggctagcgcaacccgccgcccttgtgccgggtagcaagcttgtggatgcacctccacatggtcagaccatagaggatgtgctaaaaattgccaaagattatgaattgatcatcatgcacactagcacaccttcgttagctaacgatgctaagtgtgcagaagcaattaaagccaaaaatcccagtgtgcagataggttttgtgggagcgcacgtagcagtattaccagaagaaactctacgcgattatccagtcattgactttgtatgccgtaatgaatttgactatacctgtaaagaattagcccaaggtaaaccttgggaagaaattacaggtctgagttaccgtgaccataattttaatattcgccacaatgaagaacgtccattaattcatgactgggatgctatgcctagtgtgctaccagtttatgggcgtgacttagacatcacaaaatatttcatcggttatttacaacatccctatatttccttttacactgggcgcggttgtcctgcgaaatgcactttttgtctttggccacaaacaattggcggtcatctttatcgccataaaagtcctgaagctgtgggacgggagatggaagaagccaaagccatctttgggaacacagtgcgggaatatatgtttgatgatgatacttttaccattgataagcatcgggcgatcgcaattagcgaacacatgaagcggctgaaactaacttggagttgcaacgcccgtgctaacttagactacgataccctcaaaactttgcgtgacaatggtctacgcttgctgctagtcggttttgaatctgggaatcaagaaactctcaaccgcattaaaaaaggcatcaagttagaggtggcacgggagtttatgaaaaactgtcataaactcggtattactgtccacggtacctttatcattggtttgccaattgaaaccccagaaaccgtagaagagacaattcgctttgcttgcgaacttagtccccatacaattcaagtttctatcgccgcgccctatccagggacagaactttatgaacaagccaaggaaaacaattggtttagtgaccaagctttagtagctaactctgggattcaaacctcaacgttgcaataccccacactttctagtgcggagattgaggatgctgttgagcggatgtatcgcaaattttacttccgtcccaaagcaattttaccaatcgtgcgagaaatgatcagcgatcgccaaatgttggtacgtcgtttgcgtgagggtggggagttcttcgcttacctcaaagaacgtcgcacccaatctgtagccaacgctaaagctcatcagacggctgtaatttaacgtgagttcactgaatgtcattgcccagcatcgtcgcctagtcatcatcaatgctgatgattttggcatttctagtgatgtcaatcaagcaattatccaagcccatacccaaggcgtgctgactagtactagtttgatggtaactggtgatgctgccgaagaagcgatcgccttagcacgtaatcacccaaatttagcaataggtctgcacttagtgttagtatgcggtcgttctgttttaccagtttcccaaattcctcacttggttgattctcaggggaacttcccagacagtcctgtattagctgggttgcgctaccaattccatcccgcagcccgtgcagaactacggcgagaaatccgcgcccaattgcagaaattctctgattcaggactgcccctttcccacgtagacgggcatttacacttacacgtccatccagtggtaatgcgtattttggcagagttagcaccagaatttaagattcgggtaattcgtttaccctctgaagaattgggaatcaacctcaagcttaaccgtcaggatttactgactaagctggtttggtcgggggtatttggagcattgcgccgctacggtgaaggtttgctgacatctgagggtattggctttgctaaccgagtttatgggttgttgcaaactggcaatatgagtgaggaatacttactcggtttgatacctcaaattcaggcagatttagtagagatttattctcatccctcgctattaaacaacggggaaacagaattagctgctcttttaagtgaacaagtgcgtgatgtgttggttattaatggctttgaattgactaactatgccaaagcaggttgtttaaaatcagacctagcttcaggtaagtagagcagtataaatttatctaaattatgtgacgaaatgtagtatttatacaagaacgattccgcccctgtgatttagcttgataaagagcttgatctgctgcctcaattagatccaaaggaatcatatcaggcgtaggaattaccgttgcaattccgatactcaaggtgacgtgctgctttacagccgatgcaagatgaggaatatttagctgtttgatagcttgatgaatttcttgggcaacctgaaaagctttatgaatcgaggtgttgggtaagatgacaacaaactcttctccaccataacgagcagctaaatccctagaacgtttgacactttgtttgaaagcttgggcaacaaggcgtaaacaatcatcaccgccagtatgaccataagtatcgttatatgctttgaaataatcaatatcgcatagcaatagtgagagaaaaccttgttctcgtaaaagatttttccatacgcaatctaacctggtatcaaaacatcggcgattggggatttgagttaattgatccaccattaccatattttcaagttgttggttagcaacttgtaattgttgataaagttctgattgctggatggcgatcgccaactgtgttgccaattgcctcagcagttcgccctcccaagtttgccactcacgcggagcgctgcaatgatgagaaatcaaaagaccccaaacaccatcgccttgtaaaattggtacaactagcttggctctgacttgtaactttttcaataactctagatgacaaggggtcaatccggcagtgtagatgtctgaagtagctttgacggtattctgttgataaaactgtgcctgtgtttctacaaaatatgtttctgtaatttccatattcaaaatcgcctggcaaccttttgctacagactccgtgacaactacaccactccaatctgggttaaagcggtagataatgacgcgatcagttttcagaaattgccggacttcggcaacagttgtattcaatatttcatccaagtctaaagaatcgcggatatgttgagcgatcgcactaatcatgcgttcccgttctgtctgctgttgcagggcaattagtgcctgtttgcgaattgtaatatctgtaaatgatgccactaccgcatagggttttgattcatcgaattcaaacagtggctgagaattgattgaaatccaagtcaagctgccatcaggtttgtgaactcccataatcacattaaattggggttgtccggtgcgtaaggtgacaatagcggggtgagtttcgcctggaaaagcagtaccatcttcatgaatagctcgccatcgcggatcgatggaagttcgccccatcatttgatcggctgttaaccctaaaattctttcggcactctcattacaggcggtgattcgcccatcagattgctgtaggacaataccttctgccatcgccgtaattacagaacgatagcgctgttcactttctctcagtgcttcttctataccatgatgttcatgtagtgcagtctgttgcttggtaatatccttttcgttgacgagaataatagagatacccgtaactggatcacggatacatcgtatgtccattccatgccattttataccctcagtggtaaacacctgagcttctatactgaatacctcacccaaattaaccgcctcaagagcttgttgcccaactctaggatcaacaaagtgactcaggaaaatattctcagttgacgaattagggtatagggtatccccataacagtcaagggctgctgggttttgtataagtggtataccagccatcgtgtaaagcgaaatcatcactgtggtgtgacgcagcgcttcaattgatctcaatattgcttgatcaatctgattgataacttctgttgttgcttcaaccagcatcgccattcgcccttgttcaatttgaattccagaaaagaggcagcgagcagaaacaggttttccttttgggtaaaatgtccagctttcagtgatggttttcccttgctgaaattcttgcaaatatctttgcattcgagcgtgagtagactgggaaatatcactgaagttgcgattgagcaattcttctcgactttgagcattccaaatatgcaaagctggctgattcgcccaccacatctgcaaattttgaatatcataaatccaaactggagtttgtaatcggtcaaatgcaatcaagtctgcggctgatatattcttcggcgatgctgtttttattgcaactaattttctctgatttttgtacagatttctttttacctgcctcaactttggctgaactgtcaagcttttcaggttttgattgagttgtggagtgactttttggtagagtgtagaccattgccgatgatgttctgcttgtccaaaagtgattcttagttctgcggctattagttggagatactcaatttctaaagaactccattgacgtaaaccactgcactggtgaacaattagtaaaccccataaatgaggaaaagaactagaaactccatcaatttcttgattgtttactaaaattggtactactaaattagcttgaatctgcaaactggataatagctctttgtaacaagggtcaagatttttagcattaatatcttcaatgacaccaacccgtccctctcgatatcgctctaaccatattgcattgaaacaagggtcatagattaattgtcctaaaatcggtttccatgaactactgacagactcttctgctattaccccatctccatcagataaaaagcgataaatgatggcgcgatcgctttctaaggtttttctgacttcggtgacaataagtttgagaatttcactcaattcaagggactggtgaatctgcacagccagcatcctaatatgatcaaggatttgcttgaagtcaatttcagaacccgatgcacgatttaatcgcataaaaaatacaattaatatataaaaaattaagcatatatacgtaaataacgatattaaaacacttgattaaatgggggtggtgacaatatagctcaagcaacatttaattccaagtcaatacataataactctccgtctgcccatttttgaaaatccaaaattctagaagccttataactttattaaatttttttatacattagtaatgtggattatggaaaaccttaatttacaagcgtataattcccaaaaatcaggttgttaaacactttaattgagtcaaaaaccaggcgatcgcacttaaatttactgcttgaaacagtaatttttcaattaccaactcactaaaatttactggttgaaactcttgagaaaatcctgatctgagtgaatgaaacagccctgcctcgcctcataatttggaagttagggcgacaaaggtaagtgttaacatcaatcggctgtagggacgtacagcagtatgcccctacccctctatttgtatcgggtgtttggtaagatggaattatccgcaaaattttgagttgcttaagattgtttattgttatagctagcaacagcttccctaagattaccttgatgttcagataaaagccgatcgcctgcatttttctctaaaccagtccagtgcattagcaacgccagttttacccacttcccactgtgttctagtaaaaaaccggcagcttctcgacttaaacccgtgaggtcttgtaaaattcgcaaagcgcgatcgcgtaatttttgattagttactgccacatctaccatgcgattgccgtaaactttgcctaacttgatcattaccccagaagaaagaatatttaaagttagctttgtggctgtaccagctttcaagcgagttgaacccgcgatgatctctggcccagttaacagacgaatatcaatatcagcctcaaaactcacttgttcaacaggaacacaggcgataaaaatagtcaatgctcctcgttgacgggcggcgttgagcgccccatgaacaaaaggtgttgtaccaccagcagtaataccgacaactacatctaattgcgtaacctgtctttgagcgatcgcactttctccatcttcggcgcggtcttctaaatcttccgaactccgtaccagtgcgccagcgccacctgcgataattccctgtaccaactctggaggtgtacaaaacgtaggtggacattcagcagcatctaaaactcctaacctcccactagttcccgcaccaatataaaacaagcgtccaccgtggcgcaaacgttctgcggttagttcaatagcttgggctaactgaattttagcggctgctacggctgcaactgcgttttggtcttcactattaaacaactccaccaattctaaagaactgagctggtctaagttctgactgtagggattcacctgctcggttaagagatgtccgcgttcttgcaaatttgtcattgtttgtcctacccttatctttctgagacgctaacacgaagggggagccgccagcgcgtctatgtcatttgtcaatatagcggttcttgtagagttaaggtacagaacaaaaattaaccaaagatgtacagaacttatgcacgcggtgtactaaataaaagttagggttatcaaaggtcaatggtcaatggtcaatagtcaatagtcaatagtcaaaatcaaggtttttggactattgactgatgtgcatccctacgaaattataataacccttctagttgacggcgaattttatctagttccgagtcagataactctggttcgtcttgtggtatttgtttggaatccaaagtatttccaccagtatccttgttttcagcctcagattgccattcagtttgtttaacattaatttctgggggaattgccaaatcactgttttcccgaacaagttcccaatcataatcagcgctttcacaaaattccttgatttcctcatcatctattagttctactgtaggtgtaagaaaatcttgggcttcgagtaatagagcaaagcggagagcatcatcttgcgactcgaacatcagaatttttttgcgatcgcctatccgaatggtatggattccctcattgtctgtattggcattaaaaattaacacaaaaacacgcatagcgtaatcgtctgtccttttattctggggtctcttaatattattaaagttctagactgtatcactgagaaggtaaaacgacaattttcacattctacagcagtcaacggcacagttatggcaaagtggtgagtgctgttagcggtagcggggcgataagcatcgtaaaaacccagttaattcaaggttttgggcaatcaacactgtcctaacatatctgactacggctatagttagcccgaatttctcactcatagggtgggaggtgctgcgttgcataaagagatggcttttagcacccactctcaattcctccccacactccccacactccccacacttcccacactccccccactcccccactcccccactccctagaagtcgctaattatgcgaataatcctcgatagaaacaagtcgccaacttgaatcttgtgaaagttctagaacccattgatgataattaaacaaactttctcggtgtccaacagagataaaagttgtttgggtttcttgtaatttttgatataaattctcttcattcctcaaatctaaggcactcgttgcttcatctaaaataataaagctaggacgattagctaacagtcgtgcgaaagccaggcgttgttgttctcccagggataatacattctcccaaggaacttctgtatcaaacccatcgattctagtcagcaagttttgtaggttaacttcttgtaaaagttctgcgagttctgagtcagtctttggacgacctctatgaggatagagtaattgttcgcgcaaagttcccaaaaggatgtaaggacgttggggcaaaaataagacttgttctaagggaggtcgcactaaacgaccagttcctgcattccacaaaccagcgatcgctctgagtaaagaacttttccctcgaccactggggccaacaatcaataaaccttctcctggttgaacagtaagtgataattcttccacaatcacctgttcatagtctggtgtttgtaaagtgacgttctcaaaagccagacgattttcttctattgtcttaatcgtactaacattctctggttctttggtaacagcttctaaagtatctgaaaattcagctaaacgatcaacgtaactagaaaatcgtcctgaagtcccaaattcatcgattaatgttgccatagcagtagcaaacataccgcaagataaaacagcttggttaacttgtccaaaatcaatgtcacctctaatatatgcaggtgcaaatattaaaaaaggaaatatctggataacagaccgatatgccctggcataaatgtcctgattcttttcccaatcaattttgcgttcagtagctttaaagatattattaaatctttgcttaactatatttaattcttgcttttctccctggaaaaaagctattgattcagcatgattacgaacatgagttaggctataagtgtagtcagctttcgattctagttcttcttcagtaatcttatttaattcttgagccaagtaagcagcaatcaaattacctactacagtataaaccagcaaaataattgccgcaaattgggaaattgaccagagaattattaagaaaaccgacatttccagaactttctctaaaacagtagttgagaaacttagagcaattcgggcaatgggttcaatttcttgggataggcgttggtctgggttatcgatctcagatttaaagttgattttataatagctacgattgctaaaatattttcctaaaacgtaattatttagccagttataccaatctaaagcgattttttttcggacaaatttagaaaatgctgtcaaaagagtgatggacagcagaccaaagcagtaaagcaataaagtactaaaaaacttagacaaatctttatctttaataatgacatcaatcaaatagcgatcgacgaaactattcacggctgttacgcccacaagggcgaacaccaagaaaatcaataaagccagcattccccaggcgcgaatcacctctgaaaatggtcttccttttgggtctgttggataccaataaggttctgcgatcgcttttaccttttcccaaaattgattcaaagccgaaggaacattcgttaagggttgatcacgaaaaaattgagtttgcatggtctagaaatatggcgtttgcggttaaatcctgtgaaatcggactaggaagttatcgaacagaattcagtagtcaggagtcagaatgctgctcaacgccccgctactgctaacagaatgaattttgaccgaaaaagcggtaagcgttgcgtaaagccttctctacgagaggctgcgccaacggcatggcttctctacgagacgctaccgcgaacgcttagagcaagtcattgagcgtcttgattctgactcctgaattctgatttctgaattcttcttcaatttcttatcttgcagcaatttggcgctattacttaacttagtgccattcaactttcaatgtcaccaaatctaaaagtaaaattattactcgaccaaaatcgtcatcatcaaaaatcaggggaaaagggaaaaagcgctcaaagccttttccctttatactttcctcgtacccttctcctgacggagacgctacgcgtagcttgcttccacgtagtggtacgggaacgcttttagcgaatgactgacgatcacagcgaagcctttttctcctcttgtaaaaatgtatttttcacaacgaggtctaatcttgatttaggctaataaaatagcagctaattcatcgatttcttgacttttggctgcaatcagcctggctgctgacgcttttagctgacgaatattttccggcttggcattatctatttcttcaagttcactattgaggaatgtttgaaaccgataataagaacctttactacctttattaccaggctcaaacaaccgttctaattctcccgcaacaacttcactacccccatcaagcacaatatttaaaagaggttgtgtccattgcaataatccccaatttttcacatcgttataattataaacacttgtcaaagaacccgtacccaaagaaactagcaagatatcatctctatgcaagacttcttcctttgcttgggcgctaattttcgcttccaaaatagccaaatatgcgggattatttgcgatcactcctccatcaactaaggtataaaaacccttgggattatgggtagttggaacgcgatagggagcaaaataagtcggagttgcactagttgctagtgctgcatctgcgatggaaaatcctaatgataacttacgaaactttttagactctgtttgctgtttttcaagtttgtttgtaaagaatattggaattcgttgctcaagatcataacttgtgacaaaaacttctttgagagttttggttagaggtgtgtctccaaaatattgttttaaaacttcctctcttcccttagaagaatattttggctggacaaatatatcttctaaggaaccaagtaatttttcaaagaatggctcgtaaaatatatcacccccatattcagcaaatatttctacgagttgttcagcactatattgtgcagttggtgaattatccaatatctctggacctaatctgggtttggtgagtccgagtgcaagaattcccccgcttgaagtgccagcaattaaatcaaacaaactaaagattggttgtttcgttcgcttttcaatttctgcgaggatgagcgctgggataatacctcgaatgccgcctccatcaatggaaagtattttgtatttaggattaggtgttgtattcactgtttttttcgattccttttgtgttgatatttgtacttctttctgttggacaaccactggaactattttgcttttttcagcctgttttcttggctcttttgttttattagaaggctcttcaataacttctgtttgggagatgcgatcgcctacaggaacttcggaatcaggctctgacgttactactaccgccaatgactcatcaggaagattctttgtaggctcattctccttcacagatttggcagtccgagatgccgccaatggctcatcaggaagattctttgtagactcattttccttcacagatttggcagtccgagatggaagttgtactatgttccaactgggatcaccacgcaagttgccatcataggcatttccagtctgatctttgacagttgtgccttgtccttcatttaatggccagtaagccactaatcctgtttcgttcccgactaaagatccagagcgatgcttctgaatttctgcttggggaagggcataattccagacaccaatgtcagctaattgacctgtgaagaatatattgttgtgtaaagttccgccaagagtcacagcactggttgctttgtttagagagtcgcctgcaagagagccagtatactcttgttcatcaagatatattgttagttgacctttattaaaagcgatcgcaaaaaaatgccattgcccaacagttaattctccattgccaaatgttttaagagcattgtcaattttctcatcaatgtaaatatctaaattacctgattcattgataccaaactcaaaattatcactgtatcggtccgaagcacgggcaaaaaaaacattatgtgttccataggtagtagctttatctgttagttggagaggatttatccatcctgaaatagtaaaagctgaacttccctgagcgaaaacaccaccaatatcctttctaccaaaatctatgtaatcatcttgaccatcaaatgaaatcactgattggctatatgtttggtctgtcactaaatttgaatctcccaatcaaggtacaacttatattgagcataaattttattggctgaaaaaaatcatcaagataataaaagagaagaatgagcatttaaactttattcatttattttcctcccaactactacacgcttgctgttccaaacttcaggattaacaatgtgaattggctgctcaccctgaagcacttgcagtatttgattagctgcggaaagtgcagtagctatagaagcttcaggtgtaactccagccaaatgaggcgacaaaattacattgtcaaaatcatataaaggattatcaaccgatgggggttctggctcaaatacatctagtgctgctcctgcgatcaatttatcacgtagagctacaattaaatctttttcacggactatcttcccacgagatgtattgattaaaaaagcagtgggtttcattttcttgaaagtttctaaagcaaacatttgatatgtttcatcagttagctcaggatgcaaagatataaagtcagattcagctaaaagttcatctaaatctttgacgagggttgcgcttactttttctacttttgtggatgagatataaggatcataagccaaaactcgcatattaaatgctgcactacatttttgagcaacagcactaccaatcattcctaaaccaacaataccaagtgtttttccttccacctgaattggttgtatctgattacgaattaaatagtttcctgctttgacactctgattaagaaaagtcagatttttcgcaagagataaaatcaagcaaatggcgtgttctgcaacagcagttgttgaaagaccaggattattgactacaacaattccattttcggttgcagcagcaatatcaactgcatcagttccgtatccagatgtgctgatgacttgtaaatttttagcaagtctgatggactcggcatctaacttattaggataacgcaaaaatactgctgatacttcttgaatagcatcatttatattatttttagttggttctttcaaaatctcgatattagtagattctccgaggagattttcacccttttcgtggtacattctcccaattaaaagaaccttatgagttttaatatttgttgctgaagttttggaaaaaatagctgtcatgatgatttctcctcaattaaattgtttcacataaagatgttttgtattcagataatgtcatcttttctaccagagaattagcattagacgtggtttgatctaatagtaagtaaaagttttcagcaatggtacttaaaggatcgatcgctttaatagagtcaattttatttagcttgagagatttggctaagagatgaaattccgtacaaccagaaataaaggaacgagttttatacttatctagtaattcttcaatatctgcaagaattgtcagtggatcttgtcctcgttttagtactttaaagatcatttcatggatcaactgctgttcttttgcagatggagaaataatctgattggcagcagtacaacctttatgaaacaattttttatgataagtgcctgtacctgctagtaaaagggctggttcatcatgttgttgcagttgttgatccgcaattttaattaaggaaattactttatttgtcagatgttctggaatatgagatagagcataatgagcggtgcaacagccaattactatgccgtcaacaaattgactgagattttctagatgcagttgcaaaaaatcaatgaattctctttcattcccgttatgaatggaactagtgcgatcgggtgcagaaggaagagagaaaacaatgacgttaggtgcttcttgttcgttatcaatatactgattgtattcataaattgatttgagaaattcgacagtaactacaggtcccatcccgcctaaaactccaagtgttggtggttttttattcatcaagcttctccaataaattgtatttttaactaaaaattgaaatctgccgcaaacaggttgctatcttctttatcagaatttgctggttgaaaaaatagcttaattaatgctgtattcggagcttttactatttcatttattagaacttctaacaacttaataatcaatgaaatacgttcagttgcaaatacatctgtattgtaaattagcttcagatatagttctgcttcgtctctaaaaataaattctaaatcgaatttagcagtaacaatatcttgctctatagggctaacagtaattccgtctagtgctaggtctacattttgattattttgcaaaacaacaacggtatcaaatagaggattccggctaggatcacgctggaaattcaaatctgatacaagtttgtcaaagggatattcttggttattgtatgcctctaatgttgtggtttttactttggcgagtaaacttataaaactatcgtctactgctatttgatcgcgtaaaactaaagtattgacataaaagcctatttgttcttctaaatctggatgattgcgtccagcgatgggagaacctactgtaatctcattttgttcggtgtagcgaaacagaaaacttttaacaaaagttagtaagcccataaataaagtggcttcttgagttttaagtaatattttaaatcgcttgattaattctgggtttggcttccatgtaaccgcagtccctcggaaactttgcaccactggacgggcataatctaaaggtaaattaagacgtgcaggtgcaggagtcaatttagctagccaataatcacgttgtgcttggagttctgagctttttaaccgcttttcttgccaaaaagtatagtctttataatgaattcttaaaggtggtaataattctacattttcttctccgtagccatgataaagcgcgagaaaatctttaattaaaacgcctgctgaccaaccatcagaaatgatatggtgcatattaaacaaaactatatagctctgtttacttagtttgattaagttaactttgagcaaagtttctgtttctagattaaaggtagttttggcattattgtgaatagctttagcaataatttctttttggttctcatactctgttaagtctatttgctggactgcaaaattcatttgctcatgcacaatttgacgtggctcattatctattaaggtaaaggtagtacgcaggatttcgtggcgttttatcaaattctgaaaagcattttcaaaagcagcgatatttaaatcaccgttgaataaataagcactgggcattccgtaggcattatgattgcgatcgaggaattctaaagcccaaaggcggcgttgcccatgagacatgggataagatttttgctgaattattgcaggtatgggttcttgataatcgtattgggttttagctactaaagctgctaatccggctatggtgggaactttaaaaaagtcagccaatttgactaacacatttaattctttatgaacgtaagttaccactctcgaaagcagcagcgagtgtccaccaatttcaaagaagttatcaaaaatgccgatgggatgtgtggtgagaattttttcccaaatctttactagcttggactctaaatcattgcgcggtgcagtataatctgcctgtgttaacttaccgattccttggagttcagcaagcgatcgcaagtcaattttgccatgtctggttagaggaaattgcttgaggaagataaaggaagtaggaatcatataaactggcaaaaatttagagagaaattctctaatttcagcaatttcgatgtctttatcagtttgacaataagcagataattgagtttgattatctacattgataggcaatataatcgctctttcaatctgagcatgacggctgagttgatattcaatttctcctggatctatacgataaccattcacctttacttgattatctttacgcccaataaattcaatgacacctggagcagtttgtttacctaaatctcccgttctaaagagagtttttccctcacttatcaagctgggttgaaatttttctgtagtgatgtcgggaagattatgataacctgcggctaatgctacaccttctacacaaatttcacctactacatgaagaggtacggtgttattaaattcatcgaggacaaataagcgattattatggaaaacttgaccaagaggtacgtctgtatttaaattttcgtctattgtatattgagctactcctacacaagtttctgtggaaccgtagacattgctaacgatatcagcttggaagcgttttcttaaggcgatcgcagtttctcggtctaatttctctcccccgcaagagatatattttaagctgggaatagtttctccagtgtcgagtacagctaagatttcccgataaatagatggcgttgtgtgcagtgcattaatttggttttcctgcaaaaaggaaactaaatgccctatatgtttgacttcatacatatataaagcagcaccaattgtcaacgggagaaaaatatttcgtaaagatggatcgtgagtaacaggcgcggtgaagatatagcgccagtcaggatgtttatctaagtcaaaggtaagtcgtaaactccgaattacattcaaaatagagatgtgacaacccatgactcctttggggtttcctgttgagccagaagtgtataagatataggcagtttggctagaatctggtttaattttaggttcagtgttgtcaaattgtgctagagtttgagcgattttatctaaacaaattgcttctatatattgaggtaattgggaaacaaaattactttcagtaagacatatttgagaaccactatcttttaagataaaatcgatgcgtttcttgggatattctggatctataggaacataagttgccccgattttaaaagcagcaagaatgccgataattaagttttgattacgtccgagaattagggcgatcgcttttcctgaaccaagctgatattcttgatgtaagtaattcgttaagcggtttactttctcattcaattctcgatagctgagagtactttgcccaacaattaatgctggtgcatttggtgtagatttgactttagcaataaagtcatcgatgattgttgcattttggggcaaatctattgttgtccctgtcaactctgcaagtaatttttgctcttgcgactgtgttaataaaggcaactgagaaagtaaactattgccatgattaattacgccctccatcaaaatttcaaaactttcgagaaactgtttgatagtttctgatttaaacagttctgtattgtagttgcagtagataatcagcgcgtcattgatttcgatgaaattaaagcctaaatcgaaaggggtatatccaatcggctctggtggcagcgagacttttaattgctcaaactcaggtagagttaaactagggtccatattgaaagatacggatatcaagggagaacgagaaaaatcccgttgtaattgtaaagctgctaataactcttctaaggcgtgactttggtgtttaaatgcggctatgagtgtttctttggtatggcggagatgttcagcaaaagaagcagtgatatttgtctggatacgaactggtaaaaattgtgaacaaaagccaactaactcctcgcttccttcaaattgtcgtccagaaatgggaataccaattactaagtcatcatggccagaaatgcgccgcagaaaagctgtgtaagcggcgaacattgtcataaataatgttgcttggtttttgcgtcccacagcctgcaaatttcgccacagttgaggaggaataacttgactttctctacctcccatgtaagttttgacagcaggacggggaaaatcagtaggaagctcaaatacggggatttccccctcgtaggttttcaaccaaaaatcacgatgctcttgcatctgtggactttgcgcttcttgctgtcgcaaagctaaatattggcgaaactgcattggtggcgctaaattgtctgtagcagcgccaatttttgctgaataaagtttgccgatttcattcaaaattagccctagtgaccaaccatcggcaacgatatgatgggtttttaaagatagcaaatagtgttcaggtgctaaacgcattaacacggctgcaaataatggagcgatactcaagtcaaaaggcttttgagacaactgagttctcaattttaaagcagcagcttcggggttttcttcatcagtcaaattgattaatggtaggtcaattttgacactcttgataacttcctgtagttcgccttgttctaaaatttgggttcgcaaagcttcatgacgattgactacttcattaatagcttgctgtaaagatgaaatatctatataaccatgcaattctaaggaagtagtaacgttatatgatgccgaagcggtggtgtctaattctgccaatagccaaagctgacgttgcgcttcactagtaggaaatgtctggtttacattattcctaccatcttcatcgtcagagcgatcgctttcttctcttttctttgcttggggtggtttggcattttcaaaaaaacctgcttgtcgcagttctgtaatcgcttctttgacagcaattactactttatctatatcttcattagtatgatatgtggagagaaaacaaactcgtttttcccatgtataaatgcctttaagatttagcaagtaataaaagagtggtaattcgattggttgtagaaaaagactataagcgccaaagggttcaaagcgaaacagagaaccaaaattaacaatgcggatgggaataccgatttcttgaaaaaattcgttaacttccgttgctaatcgattagttaattgatttactcgtttttggagtgttccaccttgttcgcgtaaatgtagcagcactgcacgacaagcagccaaagccaaaggatgacgacaaaaagtcccaccataggcagttaattctgtttgtggatgggaatcatctccataactccaaaaaccgccatcaactgtatctaagaaatctgctttaccacagatcatactgataggtaaaccgccaccaattgccttaccgtaaactactatatctgcctcaacatcaaaccattcctgcgctcctcctagagccatgcgaaatccggtaataatctcatcaaaaattaacgcaatctctttttcatgagttaattttcgtaatttttgcaaaaattctttaggctgtaaatctggtttacggctctgcactggctcaactaaaactgctgctaaattatcagcttgagcagcaattatttctaaactttcttcggctccataggtaagaactattacgtcttcaaccattcctgatggcgtaccaagactcaatggttgagcagtttctggctcctctccaactcgcgctaaaatgccatcaaaagtaccgtgataagaaccagaaaatagcacaattttttggcgttttgtccgagaacgagcaatgcgaactgctgccataattgcttctgttcccgtattactaaaagcaacccgttctacaccagttatttcactaattaaagcagccgtttctgccgcaatattagattgcattcctaatccgattccgtgttgcatttgctgttgaactgcttctatcacgaaatcaggactatgcccaaaaaagttaaccccaaatcccattgctaagtcgatgtaatcattgccatcgatatcccgaaaatatgctcctttggctgattctgagacaatgggatattgaaattcttttaaagccatacggaaatcaatggtaggtttgacatcaaccattgttttacgactattttgcgaatatgccttagatttagctgttttttgattataaataatctctaaattgtggataaaagcttgctgtttttccgttaaagatttattttcattcagctttaaagcaagtgggtttaaatttggagagctagcttttttaggtgaatcagttttaattttctgggtaagaggcgcaatttctattttagcttgttggggaggtgtaaattctgatgtagcacttggtataacaggtgcagattgcagtatttctaattgcttgataatggttttttcatgtatatctttgaggtctttcaaagattgtaattgagccatcatcaacgcttctttaccagaagtttgtattgatataggtgctgtttgttggcgaataataggaatttcaacaggtacagaagcaataattaattcttgtccattgtagacgctgacattgttttgttgagaaaaactatccgcagtggcaaaaccacagcgttttaaaacagaacaccaagtttctccagtcaacaacggactatctaaacgtaactctttatcttgaaaacgccaccatcctggtgtgagtccaaaggttaaatctagccaggaattattttctactgtttctagtagtactaagaaaccaccgggtagtagtaattcccggatatgattgagtgtttctgtaatatttcgggtactgtgaagtacattagctgctacaactatgtgataagaatgtgctggtaatctttgagaaactggggatttttcaatatctagttgatggaagttgagattatctctgtgtttaaatttttgacgcgctttatttaatagaacaggagaaagttcggtaaaattataagttacgttattgagatttaaatcattaagaattgcttccgaagttgcgcctgtaccaccgccaacttcgataatttggtaattgcgatcgctattagcaaaactatttaaaattcggctaatttcttgggctactcgttgattcatcaaacgagatacaggagaattgccatatatactttctgcatgaatcactgaacctgctgggaaaattaactctaaaggatcaatatttcctttaagaacttcggctaggttttctccgcagcgttgcaacatttccaattcaggtttggctgcgggacaatttgtttgcagattttctatggcttctggtaaagaaaaaggcgtaggtaagtttttcgccgtccagagattaccttgattttgaataattcccgcttgctctaaagtttttaaataacgagtaactaaaatatgatattttgggacaatgggtaaagtttggagtaagttttctgttgtccaagtttctgctttatttagtcgcttacctaatgctcctaaagctttgagaatataggcaatagcaatgggttgtaattgggaaattacccacagataattatttaattctgaagtgggatttaatatattagttactgatatttcctcagaggtttctaattcaatataattagatagataattagctagatcagcaattgtttgcaaatcggtaaataattgatcgattttgaccttgacgctaaatttctcttcaattttgcgagcaaagtcagtcaagattatagaatctgctcctagatttaatagggtttcatcatctctaatatcattttcatcttctttgagtagtagagctaaaatagactttaatttgttgcgaatttcttgctgatgtttttggatatttgatacttttgctacggtcattgtagtttgctcgctttctatatacacttcgttgatttggttcgtagactcaaacttaaaacgttttctttgaaatggataggttggtaattgtacatttctgtagctgtaatcttcattaaatttttcggcattaaaactaactccatgaatgtagagttcggctagtgttgccagcattgtatgccagttatccacacctctatttagagaactgagccaaatagcttcatcgttataacgacgaccttgttctgctaatattggtcttgaacctacttctaaaaataggttataccctttacttaaggcagtaattaaactttgtagaaattgcacaggttgacggcattgttttcgccaataactggcatcgggcgcattctctaaaggttttccgtcaatgcctgaaagtagtagaattttggggtgatgataagaaatgttctgagcagcagtttcaaattcatctaaaattggctccattaatggagaatgaaaagcaccgcttactgatagtgattgaacagcaattttttggtttttacagttgactacaatctcatcaatgctgttgctttctccagaaattacaatttgttgaggatgattaatcgctgcaatggaaactgtatcactgtagtttttaattagagacagtaccgttgcttcatctgcaaaaactgaagccatttttcctgtgggcgcagtttgcattaattgcccacgtttaacaactaattgtagacctgctcctaagctaaatactccggcaatacaagctgctacatattcaccaacgctatgcccaattaataagctgggttcgattccccaagattgccagagcatggcaagagagtattctagagcaaagatagctggttgagcatatctagtttgattgagtaaatctgtttgattaccaaataatatatcttgtaatggatattctaaataattcgctaaaatttcggcacatttatcaatatgtttgcgaaatgtaggttgggtttgatagagttgatgacccatccctgcataacaagctccttgaccggtgaagagaaaggcaatttttgactgtttttctcctgggaggcgttgataaaaagttatatcacgcagaggcgcagttcggctttgccgttcccgcagggtgacgcggagaggatcgggagttattgtttgtgcaaaagctgctaatttttgttgcaattctggtagtgtatctgcaacgatcgccaatcgttcgggtaagggcgatctaccaatagctgtactatgacagatatcaccgatttctggatgagattctaggcgagtgtgaaaacgttgcgctagttctttgagcgcagtttcattatgagcagaaattgtcaatagatggctaggacgttgcagcttaatttctgttgtttttgtaacgggtgcttgttcaacaattacatgagcattggttcccgaaaaaccgaaggaactaactccagcgatgcggacttcgctattgttagaccagggtattgtttgactaggaattttgatcggatatccttgccaattaatcaggggattaggcttttggaagtggagatgaggcgggatttcgccatgttgaagggcgagaatcgtcttgattgttcccgctatacctgcggcggcttcgagatgtccgatattagttttaactgaaccgacgtaaagaggttgcgatcgctctccataaactgctgcgatcgcgttcatttctatgggatctcctaaagaggttcctgtcccatgtgcttctatatacccaacttcctgggatttgactctagcatcagccaaggcttggcggagtaaatcttgttgtgctgttccactgggaactgttaaaccggcggctgcaccgttatgattcaccgccgagcctcgtaagatagcaaggatgcgatcgctctttttctgagctacagacaagcgtttcagtactaaaaccccacagccttctccccgcacataaccatttgcagccgcatcaaaggtcttacagcgaccatcgggagacatcatccccgattgggaaaggttaattgtaattgcgggatttaagatgagatttaccccagctaccaaggctaattcgcattcattatttcttaggctgcgaatcgcttggtgaatagcaaccagtgaagaagcgcaggctgcatcaatagacatagaagggccacggaggttgagaaaataagataatcttccggcggctgcactcagagcgtttcctgtaccaaaaaaggaatcgatttcatcataattgcttttgtagaccgtcatggcgtggtcaacgctggtaataccgacaaaaacacccacgcgttcacctactaaattagtcggtggtatattggcattttctaaagcttcccatgtcaccttaagtagtaacctttgttgtgggtccattgaggtggcttcgcgggaagatatggagaagaaacgggcatcaaattcgttaatatcttcttgtaaaaatcccccataacgagtgttcattttgccgggggtgggttctggagcataaaattttgagatatcccaacggctttgaggaacttctacaattgcgtcaagtccagctttacagtaattccaataagcatcaggagaatttatgcctccagggaaatgacatcccatcccaataacagcaattggctcgctttgtctggtttctaattcggtgatgcgagcctgcatcgcttccatttttgttaaggttgttgctattaattttttataatctgtgctttgaaccataaagtttattttttaacgcagaggaacgcggaggtttacgcaaagaggcgcggagtgttatttgagaaggttgagatgaagtgatttaatttctaaatattcattcaccatatttatcaagctccgctagtttttgatttagtagtattgctagttcgtcttcttcaaggctgtcataaggattgagggtatctgtttgggagttaatttttacctcaaattcgatgcgatcggctaatacttcttctcgcagataattacttaaacttgtgatattaggataatcaaatatcacagatgaggataaaatacaagctaaattattttctaacctgtttttaaattctagtaccattaatgagtttaagcctaactctaggaaggaggtttgttgaggaatcacgttagttgtatttaatccagttacctcccttaatatttgctcaattccttgggataaggttgttgttcgttcatctatagggacagattttaattgttctaataattttgcatttttgctgttttcttttggtgtgattacttctgcaaaaaatggttggttaatattaaaagcttgattaaaagtagaccaatcaatatcgagaatggctccttgggaaatgttgcccaaaaccaatttactgagatattctagagcagtatcagaagacatacttttaataccccaactagcaaagcgttgtttatcaatttcattacctgtatcccatgctccccaattgatgctgatacctggtaatcctaaattttgccgttgctgcattaaagcatccataaaagcattagcagcagcgtaactactttgtcctggtgaaccgaggattacagcagcagaagaaaaggtaatgaaaaagtctaaagatagattgcgggtgtaacggtctaataataaagtaccttctactttgggacgcatgacattttgatatctttcccaagtttgatttttcaaaagaccatcatctaagacaccagccgcatgaattaccccgcgtaaaggaggtaaatctgtaccaaaacgagaaaatatttgttctatatctgttggtgaggtaatatcagcgccgataattgtaacttgtgtaccatttttaattaatgatgcgatcgcttctggttgagatttaacattccggctacacaaaactatatgaatcgctcccatttttgatagccaatcagctactatcaagccaagtttacccaaaccaccagtaattaaataagctccttctttgctaactaattgctgtttttgtggggggggaattgttgcaggtactaaccttgcaccataacggtttccttggcgtaaagctaggcgcgactcgttgcttgaagtgtgcaattcgttgaacaaaaattcagcttcatcaggttctgctgtgggtgataaatccaaacatacacaacgcatttggggatattcgttattaattactgctcctaatccccataatccagactgttcaggttgtacataatcatcagctaatacttgatttgcaacgcgagttagtaaccataaatcaggtaattttttccacttagcggtgatagtttgaattaagtataatgctgcattacaactttcataaactgtatctgcttccccagaaaaaatcacccctgtgggaaatttccctgatggataagcttcttgatataaacgctcaagatcatacttttgagataaattgatgacaaaattattttgagaacggcatttataatcatcacctatttccacagtaatgacttgctctccagcttttttaaataaatttaccaactgactcaaagctgtatcatgatgtacaaacactaaccaagaattgttagtatttcctgcaacattggaaattgaattgagcttttgccattcaacttggtaaaaccaattcttgtcagtttcttgccataaacgctgtaaagccgtcggattagtccgccgtgcgactaaatctgtaaaccgagcgcaaagccgttcttgttcatcataaacatcgacatctacagccatttcaccattagtatcagacttcatataaacgcgtgtccaaacttgagaaccgggatttccaaaaaattccaacgaagagaaaccataaggtaaatgcaactccttaccgtgaatttctgggaaagccgcgccaatactttggaaacaagcatctaaaagcacaggatggagacaataacgctcatctactaaactgcgattaatactaatccgagcctgagaaccattccctaaatagcgcagttcttcaatagctcgaaatccctgcccatagctaatccccatctgctcataaagctcataaaatcgagagatagcaacagattcccctccctcttcctctgcgtctctgcgcctctgcgtgaacttttcattaacctcaccaccaacatgaagaacccacttatcttgcaatgaatcaaaactaaatatctcaaaaccataaccagatgatttttgtggtttaaaaatcatctgcaacgtagttagagattgagataataccaacccctgatgaatcgacacattttgtatagtcaacccatcagcaaatattttctgactagctgctaaaaccgcttcaataaaacccgtagccggaaataagattttcccaaatacctgatgtccctccagataacctggattatcagaacttatctctccctcaaaaataatttcccctgtagctaactttttaaaatcattaataaaaggatgcaacttagttttgacatcagctacagaaaattgggaatttgataaccaatagcgttctcgttgaaacggataagtaggtaaatcaatgcgcgtcccttgcttaaataccttcgcccattcaacagaataaccattaacaaaaagcgtcgccaaacttctgtacatctgggcttgttcatcttttccaggtacaatactaggtagatataatacttctttaatttgagaactgagccgcgccatacccaataaaacaggcttcgctcccaactccagaaaacagcgataaccactgtcaattaagaattgaaaccctttaccaaaatgtacagtgctgcgaatatgttgtagccaataatcgggagtggcaatttctttaccaattggtttacccgtgacattgctaataatagtcaagcttggctgatggaaagaaactctctgcaaaaccttagcaaattcatcaagaattggctccattaaagcagagtgaaaagcatgagagacagctaaacgtctagttttataactttgttctataaaaagtttctctagttgctcaacaatttcattcaagccagaaattaccgtaattgcaccattagctgcggcaatattaacttgattactatatggagcaatgtaggctgttactgtttcataatcagcgtaaattgccaccatagctccattgtgcggcagttctcccattaagcgaccgcgttggctaactaattgcaaagcatcttctaaagaaaagactccagctaaacaagctgcgacatattcaccaatgctatgtcctaaaagtgctgagggttgtattccccaagattgccataatttagcaagtgcatattccagggaaaagagcgctggctgtgtgatttgagtttgttcgagcaaatcgctattcgacacttcaaagattaaatctaatagcgatgctcctaaaataggttgcaagatttggtcacaaatatctagagtatttttaaagacaggttctttgttgtaaagagtttgtcccatcccggaatattgagaaccttgtcctgagaatagtaaagctatatttggttgagtttctgatgcaatttgcgtaattatatgctcagaatcctcacctttctggaaatcagtaagcgctttctctgctgtggtgattgagtcagctagaatacacaatcgatgccgaaaattagcccttcctgtactagcggtaaaacaagcatcggctaaatttacagattcatttaaagcagattgataatttttggctaactctttgagggacttttcagaacgagccgaaagaggcaaaaggtaaagctgatgctcagattgttgtgaaaaattagatgcaatttctcccacaataacatgggcattcgtaccactaaatccgaaggaactcacacccgcaattctttctcgttcgctaggatgccagtttttaccatgtactggaacttcaaaaatatgagaactccaatcaaaacggggattgggtttttcaaaatgaagatgcggaggaattttatgatgttgcaaggctaaaacagttttgattaacccagcaattccggctgctccttctaaatgccctaaattagttttgacagaaccaataattaaagggcgattttgggggcggtttccaaataccgcagccatactttctaattcaatgggatcaccgatcgcagtacctgtaccatgagcttcaataaaatctatctgctctggtttgagttttgctgtattcagtgcttgatgtaataatttttcctgagcatcaccattgggtacagtcaacccactactggggccatcgtgattcacggctgtactgtaaactctagctaaaatgcgatcgccatttttaactgcttgactcaaccgcttaagaacaattatcccgcaaccttcgcccctaaccataccgttggcacttgcgtcaaaagttttgcaacgtccatcaggcgcaagcatctgggcgcgactttcaattaaggaaattaccggggttaaaattacgttgacaccacccgctatagcaatgtcacactcaccattacgcaaggcattgcaagccagatgtactgctactaatgaagaagaacaagcagtatcaaccgtcattgaggggccttgcaagcctaatacataagaaagacgaccggcggctacactaacagaagttccagaaccggtataggcgttgattgcttctggagcataactcaattgtgcatagtcttgagtcatcgcccccacaaaaaccccagtttgactgttgcgtaactgttggggattttgaccggcagattctaaagcttgccaagttgtttctaatagtaaacgttgctgcggatctatggcgacagcttcgcggggaagaatgccaaaaaattcggcatcaaattgatctattttttctagaaatgcgccgtaaggagaatatatttttcctggtgtatttggatcaggatgataccacgctttcatatcccagcgatcgcctggaatttctctcaccgcatctttaccctgctctaaaagttgccagaatgattttagatcatctgcaccaccaggaaatctgcaagccatccctacaatgacaattggatcttcttcttgttgtggtttttctgagagtttactgaataacccctctccaaacctctcccccacagggagagaggctttgaaactcccattaccttgggcattaagttgatgcacctcagatatatttaaaacttctcgcaggagataatctgctaaagtttcgacgttggggaaacgaaaggtaattgttgtgggtagagaacaattaaaatctgtttgtaaaagattgcgtagttctgtagaggtgagcgagtccatccccatatcaaaaaagccttgttggggagaaactacttcatttgttgatagtcctaatacattggagacgcgtaaactaatgtggttaattagcaaatctcgacgctgttttacaggtactgtttgccattgttctaaaatatttgatgcaggttgagatttagttttgacttggggtaagaagttttgataaaagctttggttaatgtaggggaaacgttgccaatcaattgcaatcacaccagcacgcacaatcttgttaaataagattttttctaaagtattgagtgctaaatcaggtgcgatcgcatcataacctttggcggctaatctttctaaaacattgcgatcgactgctgcaccaatttggctccacggcccccaatttatcactgttgcaggtaaattctgtgcatgacgataataggcgaaagcatcctcaaaggcatttgcagccgccgcgttagcttgtcccgccgagccaattagggatacagcagaggtgtaacaaacgaagaaatctaaaggatcgttgagggttaattcatggagtagccaagttcctttcaccttgggtgcgagaacatggttaaaacgttctggtgtgagtcgcagtaatgttgtatcgtctaaagtgcctgcaatgtggaaaattccgcgtataggatattgcgatcggcattctgctagtaaggtgtgaagtttttcggcatctgtgacatcaacatctttaattttgatgtctgcgttgagtgattgcagacttgtaataatttcgggggtgagagcttctgcaccactgcgactgcataatactaaatgacgagcgccacgttctatcatccatctggtggtggctaaacctaatccgcctgtaccaccagtaattagataacagctatcttgacggaaattgatgtttccatctgctaatttttgctctactaaacgcggagcaaagcgttcatctccgcgcaaggcgacgcggttttcttgtgtatctctatagatttctcggaatagtttttcgcttacatcttgttcattaggatctaaatctatggctctgaaatttagttcagggtgttctagtattaggcttaaagcgattcctaataatgcagattgtgctggggatgtgagttgttttgctggtacggagccttgggtgatgaggatgagggcgggagggttttcttgttgtaataatgcctgaattaaaaataggaagcgttgacaatgagtttctacttgttgatatatttcgccttctatttcttgtaatggccagaggtagatgatttcacgggtttctggggtgaataagtcgggattgatttgttggggggagatgagggaacaagtaattcctttttgttggaataggggggttagattttgggctatgcctttggaatcagaaaagattatttcgcgcattcgcccttggcgttcccgcagggtaggcgcaaagtcgcaaagaagaggaaggttgtttttagcaacaatcacactttgttttaagaggttgtgtgtttctgggttggttggttcgatgatattagtttctgcaaacccatgattagtaagtaggttttgccagtgttttgtatttagtaaaggatagccgttgcgttggggatcttgactgcataaccaccagccttctgttaagccgaaggttaaatctatccaacgacgtgcgccggtactttctaatagtattagtagggcgttgggtgcgcttagggattgtacgtgttggagggttttgtctatgtctgctgttgcatggaggacgttagcggcgatgataatatcaaagcttccggggagaaaaccttgagttaagggatttttttctatatctaatgtttgatattttatgaagggataatgactaaagttttctttggctctggttaaaaatctagaggaaatatcggtaaatacatattcgatttgactattatttaaatgcggtaaaattgctgtggtggctgatcctgttccgcttccgatttctaaaattcttagctggcgatttgttggtaagttggctactgcacatcgaatagtttctgcaactaattcattcatcaacttagccccagccgcatcagaatagacagatgcgatcgcatttaaatcaccttggggaaatagtagttctaatggctctatttggcgacgcattacagccgctaaagctaaaccacaacgttctatcaggttgatttctgcaaggtaatcgggaaattcgctgcgtagatgtgggattgatgaaaatgtaataggttcttttgctaataaccagccatctttttgttgagcaacaattccttcttcggctaggatggcgaaacagcgtgataataagggacgataaaaatcaactactccaccttgagccgcaattgtttcttcttgataagttttacctaattttggttcccagttaagcttttttaaaccttcccacacataacttacgcttaaactttccatctcacccagcaagcgttcatattggcgcaatttatctgctaattgctgttctaattgctgtggttggacttgggttttaataacatcaggggtaagtaaataatctctaccatcgggtaataatggtggtagggtaatccattcttctatataagattgagcttggctttcatggcggataatttcttggcgttgaactgatttgagttcaaatccggtaattgctgctagtagttcaccttgttctgaataaatatcaatatcagagacaattaaattatggtaatttttcgttagtctagctgcactgataacgctatcacctggagagcggaaaaattggaatttagcaatgcggattgggacataagttgaagatgaatcttgctcaaataaaatagctgcgatcgcctgaaaacaagcgtcaagcattgctgggtgaaaatgatactttttggcttctaaattctgagtatctgttaacttaattcgagcgatcgcactatttttaccacgattaagtttattaattagctgaaagctactaccgtaattgactccagacttttgatatgtttcgtaaaatgaattaatctcaagctgttctggagattccgcttctatttcttctatattttgggtagttaatttagttgattttaaattctcaatttctccagaaacaagcacatcccaattatcagccgcttgattatatatgtgaaaacttgctttttcagaaacttgttgctcaataattaattgtaaaatattttctgtatctcgaagcaataaggctttattaaattctatattttctaaactaactgcattaccttctaccgcagctagcgccatttcaataaatgctgcaccgggaaagatagcttgatcaaaaacttggtgttcagccaaaaatgctggattattctgactaatactaactcgatattgaatagaagatagaggagaaggtaagcgatcgcctaataaaggatgtgcatagttatgagaattaacaggatttacccaatagcgtttgcggataaaaggagaatttggtaaactaactttctgccctgcttgataacgatgaaattcttgccaattaatatttaatcctcttacatatagttctgctaagacagcttgcaattgctgaaagttactgccatcttgagctaaactacataaccaaagtatttcacttttaggtagatattgacgaccaatattaattagactaggctgatttccaatttcgagaaatatttgatagcccatttgatgcagagtagcaattcccttggcaacatgatctgattgacgcagtttttgtacccagtaagcagcagttttaatctcactaccaacaacttcaccatgagaaattaaagtgagtagaggattatgataagaaacttcttcagctactttttgaaaagctaaaaatccgcgacttgcaaccaacttaacagcatcttcaacagaaaaaactccagcttgttgagccgcgacatactcacccaaaccagaacctaaaattgccgaagggcggattccccaagacttccaaagttcgcaaagggcatattgcaaagtaaataaactagactgcacatataaatcttgattttgctccaaataaccttgaaacaagcgatcgcaccgagcaaacgcctcacgaaacacaggctcttcccccactccaggagatatcaccccctcatcaccacaaagaaaagccaccttagtatttccttgcgcctccccacaaataaccccacttcctacctttgcgcctttgcgcctttgcgcgaaactcctaattccctcccgaaaagcgtcaacaccagaaaccaacaaagccagtcgttgtttatgatgaaaacggcctgtatttagagaaaatgctatatcacgcagagacgcagaggcgcagaggaagcgattggctaagagggttaagcgctcgtcgtctttagcagagagggtaattagtacaggaaaagtcgtttgagcaggcgattgtggttgaggaggttcactcaagattacatgagcattagttcccgacgctccaaaagaactgactcccgcagcttttatcttgccattactaacattccagggacgagattgtgtcaccacatcaagcggtaaactgtcccaattaatatgaggatttggtgtttggaaattgagatgagccggaatttccgaattatatatagataatacagtcttaattaaaccagaaatccccgccgccgccgcgagatgtccgagatttgtcttaatagaaccgactaataaaggctgagatttagagcgattgacacataaagcatcagcgatcgcttttatttcaataggatctcccaaagctgtaccagtaccgtgagcttcgatataatcaatgacatcggcactcaaacgcgcatcattgagagcctcacgaattaaatctgtttgaatagggccattaggaactgtaaaaccgccacttgcaccgtcattatttacagccgttccccgaattaacgcccaaatgcgatcgccatcttctaaggcttcgctcaacctttttaaaacgacgactccgcaaccctcgccaattccaaatccatcagcgcttgcgtcaaaggttttgcacctaccatcagccgctaacatttgatttctgcacaaggcgatcggcacttccggcgtgagaatcaggttcacacctcccaccaaagcctgtctgcattcctgcgatcgcaaagaacgacaagccaaatgaatcgccaccaaggaagaagaacaagccgtatccacagccaaactagggccattcagattcaacaaataagaaatccgtcccgccgccgcattgatatgatttccagagatatgataagccccaaccgtgctgtaatccccacccggcgcaatcagacgagtataatcattattggtaatcccaataaaaaccccagttttgccaactctagaactaggcgcagccatcgccgcatcttccagcgcctcataagcaacctctaacaacaaccgttgctgaggatcaatatgcaaagcttcccttggtgcaatcccgaaaaattgcgcgtcaaacatcgagacatcatcaagaaaaccgccttgagacacatagattctcccggctttcccccgatcagaatcataaaaatcatcaacattccagcgatcgcgcggtatatccctcagcgtactaccaccagcctttaaaaaagaccaaaacgcctggggagtagaaatatcattaccaaaacgacaacccaaaccaacaactgcgatcggttcaccctccctcgcctcaacagccttcaacctctccttcgcctcattcagcgccttaaacaccctagcttggacagccttatcattctccatctcctctccttctccgcgcctctgcgcctctgcgtgagctaaaaaatcaagaacccccaagaaaagcctccaaatccgccaattcccgcaacatcaaatcctcatcaacctcctcaatcacagcagcctccacaactccaccaaccccccaaccaaaaacctgttccaccaaataatcaaccaaccttgtaatattgggaaaatcaaaaatcaaagaagcaggtaaagaaacctccaaacctttttccaaacgatttttcaactcaatagaaagtagagaatcaatccccatttctaaaaacccttgatccggctcagatatctgcttaattcccaaaatagtactcacttgcttcccaacatattcaaacaaatgctcccgccgttccccaggcggaacctcttcgataaaacggcgtgaagaacttgattctttcacagaaacttgagctttgcccaacttctccaaaagaggcttcttcccattaaattgataaatatttttgaatcttacccaatcgacatcagccaataaaacttgtatttccccagatgttataacagcatccatcgccccaaaagctttatttaaagcaatctcctccattccaatttgtttgagccaatcttcatattctggtgaaactataccattcccagctaataaagcccaattcaaagtagtagcaggtaatccctgaaggcgacgtaaataagccaaatcatccatcgaatgactagcagcatcatataaaccttgctccttagctccccaaattgcaccggcggaagagaaaaatacaaaatagtctaattcaatccctaaagataactgatgcaaattccaagaaccccgaactttagcttgaaaaacctctgcaatatcagccgcagtacattcactcaatcgcgctttgcgtcctgaaactccagccagatggaaaacaccccgtagcggataagatgttttttggatacgttcaaatatgtcagacatttgtggaaaatctcccacatctgcttgacaaatttctacagatgcgccttttttttctaaattaataatattttgaataatttcggaaaattctatttgtaacccccactcagttctgggcggaaatttacgacgcgtagttaaaatcaggttttttgcacccaaatcaaccaaatggtgagcaagttgtaaccctaaatgaccgattcctcctgtaatcaaataagtcgcctgggcttggatagtaacgggttttgtcggtaaagattcttctgaaaccagacgcgccacataagcttgatgattgcgaaacagaatatgatcctctttagcagagttggttaatgctggaagtaaagcggcgatattttgagcaatatcggcgtgggggtcgaggtcaatcatccccccccataatgcaggttcttccaatgctgcgacgcgtcccaatgcccaaagaggagactgattaacaaaggatggctgatttactttaaatggctgaccgccttgggtgacgaggaataatttgggaggatttggtaattttttaatcgcctggagaagattgagaaaatagcgacagcgattaaataaaatcgactctgatggctcgttgcgatcgcctacaagataaatgatcccatgtaaagatgtgtctagctccaaactatgctctggatttgcgatcgcacaagagctatgatgcttgattagttcctcttgaatcgctaaagctagattttgctcactatctgtaacaattagccaatctcccgcaatatcattctctttattttgggcaacaatgatactttgctgaaataacggactaccaatttcctcatcaggagaaacaaactcagcttgagcaaagccagattctaagaggatagatttccaagtagatgctgcaattataggatgagatgggcggtaggcatcgctaaatctccaccaaccttgagccacaccaaatatcaaatcaatccaccgtgattgatgagtcaattctaagagtaataaatgtccgccaggacgcagtaaacctcgaatgtggggtaaggtttctgtttgcaaatcccgcgtggaatgtaatacgtttgcggcaataatcaaatcataagaactgggtgaaaaaccttgagattccgggtctttttcgatatctagaaccttgtattctatgaaaggaaactgggcaaaagtatctttggcattttccagaaagaatggggaaatatcactaaatgtgtaggaaatttcatgagaactacaagctttgagcaattgatgagtagttgctccagttcccgcaccaatttctagaatgcggattggttctgattgagaataatttgataataaaagctcaactgttttagatataccaagattgagaactttcgcccaagatgtatctttataaaactgtgcggctcccatttgcccatcttggggaaataagattgataaaggcgaaattttccctgtaaatatagcggctaaatttgcagctactctactaaatagtgttagttctacacgcgcattgggatactgaacaatcaaattatctactgttaaatcagggtgagattgtggcaattccttgataatcttccagtcattaccctgattttgaataatcccagtttctaccaatattttcaagcaatgattccatagtaatttatgctcctctttaatcccagcctgacgaaaactgttttctgtagagataatggtattgatttcaaataattctaaatcttttaaggctttgacaataaactctgcgcttagttcttccatttccctaaaagctagagaaactcctgtaattggtgcagattttatttgttctcccaaataagcatctaaatcattctgaatcttttctaaattctgtaatttttgggttgataaagcataaggcaaccattccaactgataaagtaagttatcgaaagtagaattatcagcattttgatgatgcagcttaattaattgttgaacaattgccgataaagtttgcttttctgcttcagaataattgccagtttctaatagagtctgcgtcaaactttttgtatctttttgagatagcatcttcacaacagcagattctgttgaagaggtttttaaaggaatccaatgccggcgttgttgaaaaggataagtaggtaaaggacatcttttaggttgataatctttatcaaaaccaaaccaatcgatatctgcaccccgaacataaagcttaccaacactttctaataaaacctcccaatcagaaaatcctgaacggagacttggtaatgttaaagaatctgatattgatgattggataattcctaacaaaacaggtttcggcccaatttcgataaaagtatcacaccctagagattggagagacaaaactccttgataaaactgtacagtagacaataaatgttgaatccaatactcaggagtcacaatgctgtcatcagcaatttctcccgtcaagttagagatgatgggaatttggggtttagcaaaattaatttcctgtagagtctttttaaagtcttcagatacaggttctattaatggtgagtgaaaagcatgagaaacatttaattggcgaactttaactttttcattggtaaagtattcccaaagttgttgaatgattgttttttcaccagaaattactgtatgctgttctgcattgatagctgcgatcgctatttttaccccttgactctgacaaacttggcgaatacgattctcactagcaaaaatagcagccatcgctccctgttctgcgggtaattccccaatcaaattggcgcgttttgtgacgagttttaacccactttcaatatcaaaaattcccgcaaaacaagccgccgcatattcacccaaactatgccccaaaaccgcagtaggttggataccccaagaatgccacaattgagctaatgctacttcgacaacaaataaagctggttgtgtataagatgtatgatttaaatctgcatctgaatcagcaaatataacttgcaataaagatttacccgttagttcttgatatataatttcacatttgtctaaagtttggcgaaaagttggctgggtttggtaaagttgttcagccattcccaaatattgagaaccttgtcctgtgaataaaaaggcaattttgggaggctgcttttcatcaacttgagcgtgaattactgactctccatcttgttggacaaaatcacgcaatttgttgacaaaatcactagtttgtgaaccagttacagccaatcgatttgcaaattgcactcggctagtattggctgtgaacactacattagagatatcgctagaatgattttcgagaaattctccatatttttcggctaaatctaccaaagcctgttctgttcgagcagaaagtgttagtaaatgatggggacgctcaatgttattctgttgcggaataatgacgggactttcttctaacacaacatgaacatttacaccaccaattcctaaagagtttaccccggctcgtctgggtaattctttaccatctcgttgcttcaaagtccaaggtatggcttcgctattgacgtaaaaaggagtcttagaaaaatcaatttgagggttgggagtattgaaatgtagagttgggggaataatttgatgtttgagagcgagagccgctttaatcaaacccacaataccagaagcaatttgtatatgtccgatatttgtcttcacagaacccaaagcgcattctccctgttgagcagcgccataagctctcgccagcgcatcaacttcgatggggtcgccgagtctagtacctgtaccatgagcttctacaaagccgatagtgtcagcctcaacccctgcaaaggctagcgcttcggctgcgactgaagtctgaccttctcctccgggtgcggcgaatcccaattttgtgccaccatcgttattgatggcagagcctttaatgactgcatagatatgatcgttatctgctaaagcgtcttttagtcttttgagcagaaccaccccaacgccactaccaaaaatagtaccattggcttgggcatcaaaggcgcgacaatgcccatctggagaaataattgaaccttcttgatataaataaccaatcttttgaggagagttcacagaagcagcaccagccaaagccatgtcactttcgccactcaacagactctgacaagcgagatgcacaactgctaaaccagtcgaacaagctgtttggacattgacgctaggaccacgcagatttagtttataggaaatccgcatggtcaaatagtctttgtcattagccaccatcgtttggaaccctcccaacgaatctaatgtgaaaggttgcaattcgtcagtactatctaattgaccgcgatttgggtaacagttattgataaaataagtgttcatgcttgccccagcaaacatggcgatcgcaccctcatataagttaggattgtaaccagagtcttctaaacattcccagctagattgcaacagtaaacgttgttgagggtcgagtaattctgcttctcggtttgtgtaaccaaaaaattcgctatcaaaatactctgctttatcaataatcggtctagctttgacgtagttcggctgattaaatagttccggagaaacccccgattctaataattcttcttcagaaaagaaggatattgtttcgaccccgtttttaagattttcccaaaaagtttgcagattattagctccaggaaatcgcccagccatgccaataatggcaatatcatgagtgtcatgactgcgacgcgaacgattttcggcacgctggcgacttttttctgctgtagctttggttgaatttgattcttcagttaagaaattggctaatgtcgcaactgtagaatttttaaacatctcagctataggtagctggcggtcaaaaagtttttctagcaggttttggacacgaattaggtggagcgaatgacctcccaattcaaagaagttatcgtgtaaacccactgaagaaagttgcaatacttcacaccacacccccgcgatttggcgttcattttctgactgcggtaagctttgaattttatttctttctttaactaaatactcattaatttcttggatgtaagttgcaaataatccttgttcaaagtctttttttaatttagctttttgaaccttaccaatagatgttttgggaactagttcagcctctaaaggaatcacataagcaggcgcaatccctactttctgggttaaatggctgcgaatttctctaactagttttactcgctgttcaagattatttgattctgggctaaaagtaataactaataaatctgtttctcgattttggtcaaaaactgcaaaggcggccgtataagaaatagctacaccatttaattcttctatagttgtttcaatttcatgggcaaagtaattgataccgttaataataatttcttgcttttctctaccagtaagaaataactcgccattgtggagatagcccaaatctcccgtagtaaaccaattgccatctgaaaaaacttcttggttgagttcagggttatgataatatccctcagtaaccgaagctccttttatctgaaatcttccaatttctttttctggtaaaacattgttctggtggtcaacaatccgaatagtagcgccaggaatgggttttcccaaagatacaaaactattttcttgcgtgagttcatctttacttaaaccggaagaccaagtaattccagaacaagattcagtcatcccaaatgctggtttaattactttatcttgtagttgatgtttttccagaagttctaaaaataagcaaatagttttaactgaaacttgctctcctgcattcactaaaaacttcattgaggagaggtcataagacgactgattaagttcttctgcgtgttgattaattaaggaaaatgcaaagttaggagaccaagaaattgtggcttgatgcttttgaattaagtctaaccatttgagtggttggcgcaaaattaattcaattggcacatggatttgctgacaagccaaatccacagccataattcctaaaaatactattgcccccacatggtctaagggcatccaattcagggtaacttctgcttgggtaaaattattcatccgcactgtgccggcggacatggatagaacattgcgatgatgcaacatcacacccttgggaagacctgtactaccagaagtgaatagtaataacgccggatctcgtggtgtaagctgaggtaattcattagggtttgacagagattgattagttcgcaaatcatctatcgataccactcgtaaaccctgtaaatgcggttgagtagctaacttttgtatttcagtaattaattccgaatctgatagaataatgggctgatctaaaatttgccagacattataaagctttttaacggcagcattctccacatcataattaggagcggtactcagaggtgcagggatgattccgcctaaaaaacaagcccagagtgtagggataaaatcttgattattgccaatttgtaatataactttatcccccaactttagtccgtggtgataaagcccatttaaaatagttaaagcgtcgttatataaatctttataagtctgaaaatattcagattcgtcatttttaatatatgtaatacccttattctcatagcaagcagcatcagccaaaacctctgggagagttttgaaactatcttctaattgcccaccaaaactaatggaatttttcaagatttcctcttgatgatcctgcctatagtattgctcatgcaaagaagtttcagttatctttttgatttgaggtatgtgcataatatttttggcaattataaaattttatagattttatgacttacgcactgtacaaattaatcattgcatgaatctcctaagatagttattttaagacttttattaataattctttgatgattattagaccagcgatgtagaatagttcatataatttcaggcttcgattttaagagaagtatattgtctccacaaccaatgtgggttttcaagctatccatatttagtctttcctgctgtaaatcctaaatttttatacgcaaattgctgcctgtagtgtttgtattttatgcaacattgtggctacacaaagatattatagggaatatttaatttttctaataatttatcataatcccaatattaggctgaagatgcaatagaaaataaattattttgtcttaactgtcttaactgtcttaactgtcttaactgtctaaattacttatatagatttctattttatttgcagcgattacagttaaaatcactcttatgctagactaatcttgttttgcgaaatgtcagattttctcttaatggcttattgtttcaaaaacacttatggtgtaaattatccatttgtggttagagaactgatcagtagttctgcaatgaatcagaggtaatcaagaacttaattaaataattaagaggatctgcccactcaaaccgatagttagagcaatggttagcgatcgctctagacgctacgatgtcttttagttggtttgtttcaccgatcaactttacaaaaagtgtatggaacttacagaatcagatattatttctctggattaccaaattcgtcaacttcgagaaattcagccactaacacttttatctaataacataaatcgtaataaattagcacaaaaagacagaataattgatacaatttctgtaaatttaagtgacaaaatatccaaactaactgctaattctcctgttaataagctggctttatatatatcagctatcaaaattttaatatttaaatatactgctcaagaagagtttgttgtagtaacgggagctttgaatacagaaaaatctgacagcctgattttttcccgattcaacaaacaaaaaatcatctcatttaaggatttactcaaaacaacccgtagtgatctacaggagggataccgctaccaaaactatgatctagatgctttgattgaaaggtttgttgctagtggtggaaatccggcagcaatttttgatatagctttgatccaagagggattttgcagccgcagttttttattaaacaactttcaattagtttttgcgattgatgctcaagatacttctgtttctgtaacttttccaaacaataattttcatgcagattttgtccagagaatgtttgggcattttcggcaaatattggaaactgtgacggcaaatcctgactgtgaattgtcagaaattgacatcctcaccacagaagaacgttaccaactacttacacaatggaacgacactcaagcagactatccccaagacaaattcattcatcagttatttgaagagcaagtagagcgcaaccctgatgcagtagcggtaagatatgaaaatcagcaattaacctatcaacagttaaacgagcgagctaatcaactggctcactatttgcaaacaatcggtgtcaaaccagaaacactagttggcatttgcattgagcgttcattagagatggtggtaggactgttaggaattctcaaagccgggggagcatatctcccattagaccccacatatcccagagaacgcctgaattatatcctccaagatacaggagttacaatattactcaccgagcgatcgctatgtgaatcgttaccagaacatcaggcaattgtgttgtgtttagatgcagattggccaattattgctaaacacagtcaacaaaatgccacaagtggggtaacgggggagaatttagcttatgttatttatacctctggttctacaggcaagcccaagggagcaatgaatacccatagaggtattagtaatcgcttgctgtggatgcaggatacttatcagttaacatcaagcgatgccattctgcaaaaaacccccttcagtttcgatgtctcagtgtgggaattcttttggccgttgttagcaggtgcaactctggtagtcgccaaaccggaagggcataaagatagtgcttacttaatcaagctgatacaacagcagcaaattaccaccatccattttgtgccttcaatgctgcgagtgtttttgcaagaaccaaacctcgaagattgcagttccttaaagcgagtaatttgtagtggagaagcactaccatctgatctgacacaacatttctttgagcggttaaactgcgaactacataatctctacgggccaacagaagcagccattgatgttacatactggcactgtttaccacaaattcagcagcagatagttcccattggtcgtcccattgccaacacccagatttacatcctagatcaatatctgcaaccagttcccattggcatcgctggagaattacatatcggtggtgttggtttagcccgtggctacctcaatcgccccgaattaactgccgagaaatttatttctcatccctttggtgatggcaaactatataaaacaggcgatttagctcgctatttaccagatggcaatattgaatatcttggtcgcatcgatcaccaagttaagattcgtggcttccgtatagaactaggagaaattgaaactgtactcagccaccacccagcagtagaacaggctgtagtcatagcttatgaggaaaaaactggaaatcaaagcctcattggttacatcgttcccaatcctcaaggcgatcgccccgagaataaccaatttgacgaacaagtagagcaatggcagatgctctacaaccaaacttacagccaaactaatatcgagccagactcaacctttaatatagttggctggaatagcagctacacaggtcaatccattcccgcaaaccaaatgcgcgagtggctcaacgacaaagtaaagataattctaacccagcaaccaaatcgagttcttgaaattggttgcggcacaggactaatactattccaaattgctccgcactgccgccattattgggctacagacatctcaccagtggcactagactacatccagcagcaattgagccaacgagagccaaacttagatcatgtgcatctatggcagcgtgcagcagataattttgagaatttagaggcacaaagatttgacacgatcattctcaactcagtcgtgcagtacttccccaatattgattatttgttgcaggttttagaaggtgcagtgaatgtagttgcccctggaggctgtattttcctgggagatgtgcggaatctgcaattgctggaagctttccacgcctctgtggaactgcataaagctccacctgatctatctgtaacccagtggcaacagcgtgtacagaggcaagttgaccaagaaaatgaactgctgattgatccagccttctttacagctattaggcagcgttttccccaaattactcatgtagagatccatttacagcgaggacagcaccacaacgaattaactcaatttcgttacaacgtcctactgcacataggagatgcggtggatatcccccaggatgttcagtgggtagattggcaaacacaacaactcacattatctgcgctgcaacatctgttagtagagacacaacctgagatattgggggttatacagataccgaatgcacgattagtaaaacctttaaaaagcgccgaattcctgaaaaatccccaggaattccagacagtcagccaactacgtgcagttataaatgcgatcgctccagacacaggagtagaacccgatgaattttatgctctagctgaggctttgtcttattctttaattgttacttggtcagatgctagtgtttcagactactacgatgtgatttttgggcaacgccaaagtcaggggcaaatccctttgagagtgtttactgccactcaacagcgtgactggcgattatatgccaaccaacctttacagccaaaattgaaacatcaactcataccccaactgcggagttatctagaaacacgtctaccagagtacatgatgccaaatgctttcgtcatgttggatgctataccactgacagccaatggcaaaattgaccgtcgggctttaccgtctccagaacaaatccgtctagaattgacagatacctttgttgccccatgtaatcccattgaggaaatactcgccctcatctgggctgaagttttgggcatcgaacaggtaggtatccacgacaacttctttgaactaggaggagactcaattcggggtatccaggcgatcgctaaagctaggcaaatgggttgcgatttttctctagcacagctattccaacatcaaacaattcaagaattggctagtttaattagccaggaattgagttctttacccacacaaaagacagaagcattcagtctcatctctgaagaacagcgtctaaatttaccagagggtgtagaagatgcctatccactcgcagcactacaagcagggatggtcttccacagtgagtatagtactaacgtccccatctaccacgatgtctttacttaccatattcgagccactctcaacctccaggctttacacagtgccattaaacaagtagtcaatagccatgcagtgctacgtaccagctttgctttgactaactaccaacagccactacaactggtttatcagcaagtcgatgttcccttaaacttagatgatttaagtcatttatcaactactgaacaagaagtagccctagatacttggattgaacaagagaaaacacggcattttgattggaatgttccgccgttactgcgttttcatctacatcgccgcagttctgaaacatttaatttgacattcagcttccaccactccattcttgacggctggagtgtggcctcattactcactcaattgttgcaacaatacttgtatcttctaggtaaaaatgttctgcctctaccagcaccacccacaattacctttcgagattttgtggcattagagcaaataaccttgcaatctcaagaataccgggaatattggcagcagcaactcagcgacatcactattaccaagttgccgaggtggtcagagtcgaaccgtgtcactaacaattgggaatcgtcagttactatatcttctagggtttctcagggtttaaaagagttaagtaaagccacgggagttcccctcaaaagtgttttgttagcatctcactttagggtgttgagcttattaactaatcagacagatattctcacaggtttagtatctaatggcagattggaggatactgacggagaacgggtactaggattatttctgaatactttgccattgcgtttaaaacttcttggtggcacttggatagacctagtgcgccagaccttcgatattgaacggaaatgcttacatttacgaagatatcccctggcggaattgcaacggacttttggtggacagcctttgtttgagactgcttttaactttattaatttccacgtttatcaaagtattattggtgttcaagatttagaagtattaggtgggaagttttttaatcaaaccaactttactttactagcaaattttagtctgcatcctctgacttcccaagtagagctaaccctgaaatacgatgccaatcagttaggtgaagaacagatcaaaatgattggcggatattatcaagaagctctcacagcaatggccagtaaaaggtcagagcgatatgaacagcattgtttacttacggataaacaacagcatcaattgttggtgaaatggaataacaccaaagttgattatgcccaaaacaaatgcctgcatcagttatttgcagagcaagtagagcgtagtcctgatgcagtagcggtagtatttgtagacgagcgcagcgaggcttctcgcagagtaaatcaacaattaacctatcggcagttaaatgaacaagccaatcagctagctcattatttgcaaaccaaaggcgtaaaacccgaagtactagtaggcatttgcgtagagcgttctttggagatggtagtaggactattgggaattctcaaagcaggcggagcatatatcccattagacccagcctatccaactgaacggctagaaatcattttggctgactctcaagtatcagtgttgctcacagaggagaagttactagcaagattatcagcaaatatagatgatgtggtgaaattagatacagataaagctgtaatttccctggagagtcagaacaatcccatcagtcaggttaatcctggcaactctgcttacgtaatttatacatctggttcaacaggcaaacccaaaggcgtagttattgaacatcaaagtagtgtggctctggtgtgttgggccaaagaagtatttactagtgaagaactggctggtgttttagctgcaacttcaatttgttttgatttgtcagtctttgagctatttgtacccttggcttggggaggtaaggtaattattgcccaaaacgctttagacttacctaacttaacatcggctccagaggtgacactaattaatactgtaccaagtgcgatcgcccaacttctggaaattcaagccatacctaattctgtgcggacaattaacctcgccggtgaacctttatcaaatcgactagcacaacagctttaccagcagaaaaatattgagcgcgtatataatctctacgggccgtcggaagatacaacctactctacatttagtttggtgacaaagggggcaattggacaaccaagtattggtcgccccattactaatacccaaatctacattctcaaccaatatctccaacccgtccccatcggtactatgggggaattatacattggtggcggaggtttagcccgtggctatctcaaccaacccgaattaacagcacaaaaattcattgctcatccttttggggatggcaaattgtatcaaacaggtgatttagctcggtatttacccgatggcaatatagaatttctcggccggagcgataatcaaattaaactgcgtggtttccgcattgaattaggagaaatcgcagcagttttagagacttatccgcaaatcaaacaagcagtagtcattctgcgagaagacatccctggttacaaacgcttggtagcttatgtagtcacacaaaaccagtctacagatagaaatgatgtccgccgtttcttacagcaaaaattaccagattacatggttccttcagcttttgtgttcttggaagctttgccattaactcccaatggtaaaatagaccacaaaatgttacctatgccagaagcggaactgactagagaacaagggtttgttccgccacagacagctattgaggagattttggcaactatttggcaagaagtcttgagacttgagcaagtgagtagagatgataaattttttgaaatcggtggcgactccatcctcagcattcaagtagtcgggcgcgctcgtcaagcaggcattaaaattaccccaagacagatattccaatatcccacccttgctgaactcgctgctatagccgataccgctacatcaatattgcctcaacaggatttagtgacaggagttgtaccactcactcccattcaacattggttctttgagcaaaatcggcagcaagcgcaccatttcaaccaatcagtactacttcaagttccctctcacctgcaaccagagttattgtcccaagctattagcaaattactagagcatcatgatgctttacggttgcggtttgtctttgagcaagggaaatggcagcaaacaagcgatcgcacttctgatacaatacctttccaagtcatcgacttatctccaactcctcagccgctacaggcacaaactatagagcaaatagcaactacccaacaggctagcctggatctgtcaacagggccgttaatcagagtggtactgtttcaattaggcgatcaatatgatagtcgattactgattatcatccatcacctggctgtcgatggagtctcctggcggattttactagaagatttgttcacagcttaccagcagctagaacaacaacagactatccaattgccacctaagaccttggcttttaaagattgggcgatgctattacaagaatatggaaaaagtcaggtggtgcgatcgcagttaaactactggttaaagcagccttggtctgaggcaaattctttaccagtagatcatcccacaggaaaacaaaacaattcagtagctagtactgctgatatatccgttaatatcagtcaggaacaaacccgcgccctattacaaaaagttccctctgcctacaatacccaaatcaatgatgtcctgctcacagctttagtgcagactttggcacaatggacaggaaaatctacagtattacttgacctagagggacatggacgggaagatttgtttacagatgcagatgtatctagaacagtaggctggtttactagcatattccccgtagtattgcaactacaaaatcaaaaccatttaggagaagctctcaagtccattaaagaacagttacgagccattccccaaagaggtatcggctacggaatcttacgttatctgagtcaggatgaagaaatttctgctcaaatagcagcaatacctttgagggaaatcagttttaactatttgggtcaattcgaccagggacaaggactcggagttgatggaaaattggctcctgagtctaaaggatctaatcatagtcttaaaggcgatcgcactcatctattagatattactgccagagtcatagaagggcagttgcaagttaactggagctacagtcgtcatatccatcagagttccacagtggaatcactagctcagaactatctcgaagctttgctcaaactgattgaccattgtttgtctcctgaagttgggggatatactccctctgattttccagtagcaaacttaaatcaacaagaactagacgaaattctggcagaaatcgactaaggaggataaaaagacaatgatcgctgaaaaatctcaacaaagcaaaaacgtagagtcaatttatcctctttctcccatgcaacaggggatgctctttcatagcatttatgctccagactcaggagtttattgcacccaaacacttattaccatctgtggcgctatcaacgttgttgcttttaagcaagcttgggaaaaagtcgtagagcgtcactcagtattacggactctttttctctgggagaagcgtcaacagcctctacaagtagtgcggaagcaggtagatttaccttggtatgatctagattggcgcaacctctccctgagtgagcagcaagagcgtctcgattccttgttgcaaacagaacgccaaacaggttttcaactcaaccaagcccctttgatgcgctgtcatctaatttggctatccgagaaaaactataaatttctctggaatcgccatcatattacattagatggttggagcttacccattatttaccaagaagttttaaccttctatacagccaaaaataaagatcaaagctgctatcttcctcctcctcgtccctaccaagactatattctttggttacagcagcaagacttgtctacggctgaaatattttggcggcgaacccttgaggactttactgctcctaccccactcatggtagaccaaccccaggtgcatggttctggagtacaaccgacttatcaagagcaggaactccatttatcccgtgctaccactcaaggattgcaatccttggggttgcagcatggtctaactttatcaactttgatccaagcagcttgggcgattctactcagtcgctacagtggagagccagaggttttatttggtgtgacggtttccggtcgtcctgccagtttgtcggcggtagaaaatatggtggggttgtttattaatactttaccactgcgaatatccatccctaagtcagaagcaattttaccttggctacaggagttgcagcaaaaacaggcagaacttcaggagtactcttacagcactttggcggaagtacaaaagatgagtgatgtgccgccaggagtccccttatttgaaagtttggtggtatttgagaactatcctatggatagcttatcagcagagccgggtgaattattgccagttagcaaggtggagaactttgaagagacaaactatcctttaactgtggcagcaatacccaaaaaagagtttctcatcaaatttaattacgacactaaccgttttgccagcgatacaattgtacgcatggctgggcatttacaaaccttgttagaagcgatcgcagctaatccccagcagcaggtaagtcaattgtcgctgttgaccaaagtagaacggcatcagctattggtggagtggaacgatactcaagttgactatcaagataaatgtattcatcaactatttgaagaacaagtaaaacttcaccctgaagcagtagcagtcatctttgaaggtcaacaattgacctaccaacagttaaatgcacgagctaatcagttagctcactatttacaagaaaaaggggtaaaaccagaagtattagtaggaatatttgtagaacgttccctggagatgatagtaggagtattaggaattttaaaggcaggaggagcttatttacctttagaccctagttatccagcagaccgtttagtttatatgcttgcggatacggcggtatcaatgttgcttacccagcaatccttagtagattctttaccagaaaaccaagccgagacgctgtgtttagatagtgattggcagataattgctcactatagccagcaaaatcccgtcagccaggtgacatcagaaaatttggcttatgtcatttatacctctggctcaacaggtcagcccaagggagtgatgaatattcatcagggtatttgcaataatttcttgcagacgattgatgtttaccaactgacgacagccgacagcgagcagaaccaacgcatcctgcaaatagctccttttaattttgatgcttcagtcttggaaattttcttagccttaacatctggaacaactctagtagtggctaaacctgaaggtcataaagatattgcttatttaattaatttgatatccgagcataaaattacccaaacattttttgttccctccatgttgcgagtttttctgcaacaaataaacttagaaaattgccgttgtttaaaacgagtattttgtggggcagaagcactaacatctgatctgattcaacaattttttgagcgattcaactgtgaattacataatctctacgggccaacggaagcatctatctatgtcacttcctggcagtgtacaccacagtctaattatcagataattcccattggtcgccccattgctaatacccaaatttatatcctcgattctgagctacaaccacttcctattggcattcctggagaactgcatattgggggtgtttctttagctagaggttatctcaaccaaccagaattaactgcccaaaaattcattggcaatccctttggcaatggtaagttgtataaaacaggggatttagctcgttatttaccagatggcaatattgaatatcttggtcgcattgataatcaagtcaagctgcgaggcttacgtattgagttaggcgaaatagaatcgattttagacaatcatccccaagtagtgcaaacagttgtgattctgcgagaggatactgccgaaaaccaacgagtggtagcttatgtggtgagaaaagaccagtcattaactcctagcgagctacgccgtttcctacagcagaaactgccagcttacatgataccttcagcttttgtgatgctgtcagaaatgccattaaatcctaacggcaagatagactataaaaaattaccaaaaatcgatgaagcatctgtaatacaatcaccctatttatccccacgcaatgaaacagaaagcacattagtaaacatttggcaacaagttctcaaggtatctaacataggagtcaatgataacttctttgatttgggaggacacagcctaaaagcaatttctctagtcagcaaaattcaagaaaagctcggtcttccctttcaactcaaacaagtattcctgcaccccacaattgcagaacaggcagaattattaatcgcttgcgcgcctattgatgtcccaataattccccgtctagctgaacaaggaacatatcaaacatctcatgcacaaagacgcttctttgtactgcaacagatggatttaagcaatacggcttatcatattgtttctacaatcaagatagaaggagtttttcagcctagtgcttttgaaaaagcgatgcaggttttgattaatcgccatgaatctttacggacatcgtttgtattagtcaatggtgagccgaggcaaataatacttacagattatcattttcatatcggatttcaagattggattaatcaacctgatgcccaaagccgcatactaaaaattattccagaaaagagagaacctttcaatttagaaaacagccctctgttacgggctaatgtttataaattgtcagataatgaacatattttgttcatggaaatccatcatattatttctgatggctggtcgatggatttattagctaaagaatgcttaaagtattacaattattttgtcaaaggtttacaaccaaatccagagagtctgcccatacaatacaaagattatgcagcatggcagtccaatattttacgaagtgaggataacaagaaaaatttagattactggcggcaaaaactggataatgggcaaataccacgcgttcacttacccacagactttgtgcgaccagctatcaagacttacaatggttctcatttaagctggacattcaaaccagaaattgtctctgggttgcgaatgatttgcagacaaacagaaagtactttgtttataggactggtagcagcagtaaaagtattactctatcgctacactggtgagcaagatatttctgttggtacagaaattgccactcgcaaccatcctcaactgcaatctttaatcggcttatttctcaatacacttgtaatccgtgatgaattagaccccaaacaagggtataaaaatctgctcacaaaagttcgccaaacggttacagaagcatttgagcattctgattacccatttgatattttaatagaagaactaacaatttcgagagaaattaaccgcacaccattgttcgatattttagtgctattgcaaaattttggtcaaactgtagtagaagaagtaaagataaaatctctggattcactaactcctacaagcaaatttgacctctcttttgtctttatcgaagaaaacaacaaactgaagttagatttaatttacaacacagatatattcaaagctgataggatacaaaaaactctgattcatttggataaattgctcaccgagataatagcaaatccacatcaggcagtctgtacaattcctctgatatcagcaacagaaacgcctttaattgaaagctttatcaaaccaatccctcgattagaaacacgcacagtcattcatgactttatagaacaagtaaaagccacaccggaaaaagcatcaattgtttatcctgggggagaatttagctatggggaattgcatagactaactaattcttgggctaatattttacaagatttaggcactcaaaaagataccatttgtggcgtgattttagaaggggatcgccggcaggttgtagcaatgctagctatattcaaagctggaggaatttatttacctctgcgtttggatgaacctgaagaacgctcttcacgcatgattttaaaaacatctccctcgattgtggtgacagccgcagaatatttagatgcagtgaaatccaggttagcagtattaccaaaaccgcctcatatattagtagttactgctaatgagattacgcagcactatgaatggaataaaacaaattatcaaagtttttctgtagtcgaaagtgataatccaacaactccatcactaccggatgctgatgattctaactatattatgttcacttctggctcaacaggtgaaccgaaagcaatacttggtagtcatgggagtttacgtcactttctaaattgggaaaaaattgaatttgggattaatcaaaactggcgctgtttgcaaattgctcaaattaactttgatgcttatctcagggaaactctcgtcactttatgttctggtggaactctctatattcctgatagcgcagaccgcgaagatttggagcgtttgttattacgcttgggagaatggcagattaatttactgcataccgtaccttcagtaatgcgtctatttttaaatattggtcagagtttagccaatgctgatcagttactcaaaaatttgcaagttttggtattaggaggcgaacctttattagtcaaagaactttgtgaatggcataaagtttttggtgaacaaacagaatttgtgaatatttatggagccagtgaaacaacttttgtcaagcactttcaccgaattcctgacccgaatcagattacctatgcgcgagttcctgcggggaaaacattgtcagatgcggcgtttgcagtcatcgatggtactcgtccctgcgctgtgggggaagtgggggaaatttttgtcaaatcaccttatttaactaaaggttattaccaagatgaaaagttaactaatttggtttttgtgccaaatcctttaaataatggcagtgatttagtttatcgcacaggggatttaggacgactgctaccggatatgactttagaggtaataggacgcagcgataaccaaattaaattgaatggtgtacgcattgaattaagagaaattgaagatgcgatttctgctattaatggtgtagaaaaagtgttggtagtcgcagtaaaaaaggaagaattagtgacagtaattgcatattatcaaggaaataacattgccaatcaggaccacatcagaagaacactaaagcaagtattacctatttatatgcagccaacttttctgatccagctagaaaactttcctttgttaccaaatggcaaaatcaatcgtttggcactaccaaaaccagaagaaaatattacacaaactactaatcaacttcctattttcagcgaacaagaagcagttttagcttcagtttggagtgaactattggaggtggaagtaagtgacattcagcagtcattctttgaactaggaggaaatagtttaaaggcgatgcgcttagtatcacacatccgcaatagctttggcatatcgctacgattgcgagaaatttttactcataatactttacaagaacaagctgttttgattcaatcgcggcaagcaaaatgataacttcacaacgatggaatgctattcaaccagtaccacagcaaaaatattatgaagtatgccatgctcaaagacggatgtggattctacatcatatagatgagtattccagcgcttataatattaggctggcaatgagaataaatggcagattaaatatttcggcatttgaaaaagcttttcaaaaaattgttagtcgctacgaaattctgcgaactacttttactagtttagcgggaactattcagcaaattgttcatgaacaaatatctaaagaacaactactattttttagagatttaagagaacaaaaagatgctgaaatagtagctgataccttgattcaagagtcggcaaactctcgctttgatttagaaaaattgtcattaatgcgagttttgttagtacagctaaagtcagatgaatttttattttgtttgactatacaccatattattggtgatgcgcgatcgcttgatattttgtttcaagaatttgttatcttatactcagcatttactcagcaagaaactgctactttacctcaattaccattgcaatataaagattatgctgcatggcaaaataagttgttagaaagtgaagaagttatagaacaacataattattggtgcgatcgctttagtgaacaaccacccatactcaacttaccaactgatttcccccgaccaaaatttaaatcttctcaagcagctatatatacttatcatttaagtccaagtctgggtgaacaattacgcactttagctacgaaaaatcatacaactctatttattactctgctaactttatttaaaatattactctatcgttatactgaacagcgtgatttagtcattggtgtaccgatttctggacgcaatcatccagacttagagaaccaagtggggttttatgttaataccctagctttaagaactttgctcccagaagatggaacttttaaacaagcactagcagaagtgacaaacacttgtcttgatgcttatgaatatagcgattatccttttgataagttaatatctaccctcgatttagaacgtgatttatcccgaaatccgttgtttgatgtaatgttttcactgcttagtcaagaaagcaaagcagtgatgaaaattcccggacttgagcatcaacaatacccacttgcaccacgaactgctcaatttgatttgagttggagtttctttgaagatgccaatgatttaagattggtcatagaatatgaaccagatatttttcgagaagaggcgatcgccaggatgagcggtcactttttacaaataattcaagcagttgtcgaaaatcccaattgccaattttcacaaataaatttattaactcccgaagaacgttatcagttactaacagaatggaataatacagcagtttcatatcctcaagataaatgtattcatcagctatttgaggaacaagtaaaacttaatcccgatgcagtcgcggtaatatttgaaggtcaaaaactcacctatcaacagttaaatgaacgagctaatcaattagctcactatttacaaagaaaaggcgtaaacatagaagtattggtgggaatatttatagaacgttccctagaaatggtaataggattattgggaattttaaaagcaggtggagcatatctccctttagatcccagttatccagcagagcgcttggcttatatgctctcggactctgcggtgtcaatattgctcactcagcaatccttaatagcttctttaccagaaaatcaagcccaggtgctgtgtttagatagtgattggcaattaattgctaactacaaccaacataatctcgttaaccgagtgacatgggaaaatttagcttatgtcatttatacctctggctccacaggtaaaccaaagggagtaatgaatatccaacggggtatttgcaataatttattgcaggcgatctctactcactcactcaccgcaaataaacgcattttgcaaatcactccctttagttttgatgtttcagtttgggaaatattttgccctttaatagctggcgctactttagtcgtggctaaacctgaaggtcataaagatacgaattacctaattaatttaattgcccaacaaaaagttactcatattaattttgtcccttcaatgttgcgagtttttctgcaagaagcaaacttagaaaattgccatgctttgcaacaagtattttgtggtggggaagcactatcttatgaacttactcaacaattttttgagcgatttaattgtgaattatacaatttttatggacctacagaaacagcaattgatgctacctgctatcaatgtacaccacaatctagtcatcagataattcccattggtcgccccattgcgaatacccagatttacatccttgatgctcatctacaaccagttcctattggcataattggagaactacatattggtggttatcctttagctaggggttatcttaatcaacccgaattaactgctaaaaaattcatttacaatccatttggcaatggcaaattatataaaactggtgatttagctcgttatttaccagatggtaatattgaatttgttggtcgcattgatcatcaagttaagctgcggggcttacgtattgagctaggagaaatagaatcaattttagatagtcatccccaagtagcacaaacagttgcgatcgtgcgagaagatactgttcaaaatcaacagttagtaggttatgtagctgcaaaagaccagttattgactcctagtgatttgcgccgtttcttacagcagaaattacctagttatatgataccttcagcttttgtaattttgtcagatttacctttaaatcctagtgggaagatagactataaaaaattgccgaaacctgatgaaatacctatagtagaatcaccatatttagctccacgcaatcaatcagaaagcattttagttaatatttggcaacaagttctgcaagtatcaaaaataggagtgaatgataacttctttgatttaggtggacattcattacaagctatgaatctcatggcactaatttatcaagaccttgagattgaaattcctttatcgatgatttatgaaaaaccgaccgtagcagaattgagcgagtatatcatctatgcccaagagatgaatatccaaccaagggaacgtccttatgtagtttttaataaggacgaagaaaaagcagtttttctatttcccccagccttgggttttgcggcggcttatgcaaatttagctgattatttaaaagattatactatctacacttttagatatattgctgatgaagcaactttagaaaaatatgcagaattgatagataatcttgcaccaaatcaagatataaaattgatggggcattcagcagggggttttttggcaatgttgatggctcaaaaattagaaaggcgcgatcgcacagtttctgatgtaattttattagatacttatcgagggggtcgtgaagctattcaagccgagatgtcagaaattcaagaaggtgttgatgctttcttattaaatcctaaacgtcaagaattaagacgttactttctggataaccaaaagttacgcgatcgcacctacaatcaagtttgggtctactttaattttctctggcattcagacatcaaaaatttgcatattaatgccacgattcacctcatacgtgctgaagaaaactatgattatgaagatgattggatacaagctacaaaaagtcaaagaatcaatcactatgcctatggcgctcatcgtgagatgattgatcctccatatctcaatcaaaactccgttattattaatgccattctcaatccagaaaatggatctgttgtctaaagtgggaatactttggcagatataattagcaccgattatttcaagccaaattcacttcattgttaaatattcatcagtgattagggattttaaaccaatttactcattcattagtcgtacacaactccaaatctattctgattcctaaattctgttttaagaaaccctttatactcttttcaatcacctcgctgcgaccaaaacaaggaactttgctatggcttaccatacctacaaatctccccctatgttgttatcatccatagtcaaagatagccgggtgagtgttggagaatatacctgctttgacgacactattacttttgcattgtggtttcctgatgaaagaattgagattggtaaattttgctctctagcaaaaaatattaccatcttcggtggtggagagcatcaccttaccagagctacgacttatgcctttcgcttgttcttcccccactcccaaacccagtttgcagagcggcgtggcgaggtgcgtcataaagggactacttcgattgggaatgacgtgtggattggctacggtgcaactatcttgtcaggagttaggattgggaatggagctgtcatcggatctcaagcagttgttgccagcgatatccctgattatgctattgctgtgggcaacccagccaaggttatccgctctcgattcagacccgaaacagttgaacgtctgctgaaaccgtgctggtgggaccgggataccaaaaaagttattgcgaacctagaatggctttaccaaaatcctgatgattggccagaaaatatccagttgaatgaatccacagaaaatttgccagatttcccagcacctgaacttctacaggaagacgttaacaactaaggttctggtgtttgcagtgtgccatgagaataaataactgatgcaacagttatattgattggaaaatttgcattgtttttcaacccccaacatgaataccagggcgcattttgtaatttttctcagcccgacgaagtacttcgcgggtaactacagcaatatcgccttcaccaaataagataaaacgcagcaaatattgtataggatttccttcaacccagccaaagtaagcatggggaattttacctgtttggtcacgaatataaagtaataaagctgcgatcgcattaggcactgctgcactctcggcgcggagaatgcggtaatcaccaacttgcacacctttgactttgatcacatccacaaattctgaggcatcagagacaataatttctaaaaacaaaattggatcattggatggaatatggttatcgtcgcgtacctctttctcttttaaaaaatactc

SEQ ID NO: 75 - DNA, 1014 bp, Microcystis aeruginosa
atgactactacttcaccaaaaactctgactatggatattcaaaaacacagggttcttttaatcggaaaaatgtatgatgaagcggggcaaaaacttcttgaagaatctactaatacagagattttgtccaaccctacactggataaaattaatgaggccattcaagaagtatctggcgtatttgtgcgttatcctaataagttagaggcttcatcaatccgattagcaaaacaattaaaagtaattagtacctctggatttggcacagattctattgatattatggcagcaacagaacagggggttatcgttgttaataatcccggaatgtcaactacagctgtagcagaacacaccttatctatgattttagcccttgccaaaaagctcccttttttagatcattgtgtgaaaaagggtaactatttaattcgcaatcagatgcaaccgattcaactcgaaaacaagacccttggtattgtaggtttaggaagaattggtactctggtggctcacaaatgtaacctagcactggggatgagagtattagcttatgatccctatgttccagccagcaaagcggagacagtaggagcaacttgggtcaaagatttagatgttcttctggctgaatcggactttgtttctttgcatactgaactaacaagtgaaacgcgggaaatgtttaatatatcagttttaaaaaagatgaaaccaacagcttttttaattaatacctctcggggaaaagtcgtttgtgaaaaggatttagggatcgcccttaatcaaaaattgatagctggatgcgccctcgatgtctttgaaccagaaccgccggctttagataatcctttatataattttgagaatgtcattctctcacctcatttagccggagtaacccctgaagcgagtctagcggctgctgtttcggcggcgaatcaaatattacaagtgcttcagggagagaagcctccttatatgattaatccagaggtgtggaatcttttttaa

SEQ ID NO: 76 - DNA, 1014 bp, Microcystis aeruginosa; identical to SEQ ID NO: 75

SEQ ID NO: 77 - DNA, 751 bp, Planktothrix rubescens
agcattctaggacaagagatttggctgagtgcaaaaagaaatgatctccgggaaacatctccacagagaaagccgagttggtttgttcccgccaagcttctatctccaaggcgttaggtttcaaatcttctaatccaccaaaagcagtaattggacaatccagaggcggtaagtccttgtaggagtaagtttcaactaccgaaaaatcggctcggagagtaggaagcaacagttccatcaactcagcattttctagtaccgcttccggtgtaccagcatagcgacgcaattccttgatcaattccgattctggtagggcgtgaatttggggagtgcgatcgggaatttgcggagcgcggtatcccgaaacgaacaggtgtaatggactttggttatattctttacgaagtagccgcgccagttcaaagctaactaatccgcccatactgtgaccaaaaaaagcaaaaggtttagttaggtggggtaatatggcccggtcaagagcctgtatcagaggctccatttgggtaaaaggggtttcccgcagtcgagaattacgtccgggaagttcgattggacaaatctcaaccgttgatggtagactatcaatccaagaacgaaatatcgcggccccacccccggcataatgaaagcagaatagtcgtaatttagcttcaggattaggttttggatatgttacccaggagttagcagttggggttagattgggctttagttggtctatttgcat

SEQ ID NO: 78 - DNA, 55575 bp, Planktothrix agardhii
gcaagcgcgccgcaggtcgacactagtggatacggtaggcgatgaaggggttggggcgtagttcttttgcggaaagttgagttgccataggtcagcactccaaagacttagccttatctttaaaattgtgccattctcaattgaggtttaccgtgatatcatcctgatctaattgtgaggttgatcaggggttatgagtgatggaagacacaggaattgggtgatttgtcccattttaatgggcgcggtaggattagttggttatctttcctatcgtagtggacaaaaagcggtagaagatatggcaaaacctttgatggtagaaatcggcgatcccgatgtccaagttgtaatagaattaattaaagaaattccagatccagaaattcctctaatccaatttctaacaaaagcagtgcggaaatttcaatttgaacagataattgacttaattgatcccctgatcaatgatcaatagcgattttcccaagcattctaggacaagagatttggctgagtgcaaaaagaaatgatctccgggaaacatctccacagagaaagccgagttggtttgttcccgccaagcttctatctccaaggcgttaggtttcaaatcttctaatccaccaaaagcagtaattggacaatccagaggcggtaagtccttgtaggagtaagtttcaactaccgaaaaatcggctcggagagtaggaagcaacagttccatcaactcagcattttctagtaccgcttccggtgtaccagcatagcgacgcaattccttgatcaattccgattctggtagggcgtgaatttggggagtgcgatcgggaatttgcggagcgcggtatcccgaaacgaacaggtgtaatggactttggttatattctttacgaagtagccgcgccagttcaaagctaactaatccgcccatactgtgaccaaaaaaagcaaaaggtttagttaggtggggtaatatggcccggtcaagagcctgtatcagaggctccatttgggtaaaaggggtttcccgcagtcgagaattacgtccgggaagttcgattggacaaatctcaaccgttgatggtagactatcaatccaagaacgaaatatcgcggccccacccccggcataatgaaagcagaatagtcgtaatttagcttcaggattaggttttggatatgttacccaggagttagcagttggggttagattgggctttagttggtctatttgcataaatttctgtttagtggaacttcaacaaattttaatttaaacaaagcttaatgcagttagtaaatatttcttgacgattgtagttctaaacaggtatccttagcattaagtctgattcagcatcttgaaacccccttaaaatctggatagataaaaataatggagcctaacgacctaaagaacttatcagatcacgagaaatcaatccaaactagagtttttaaagcactcaatgaagccaaagaaagattaaaagctgttgaagctaaacaaagtgaacccatagcaattgtcggtttaggatgtcgttttggcaataatattgccacggttgatggcttttggtcttttctgaaagcgggtggaaataccctcagagaactccctaatgatcgatggaatcgggatgatttttatgatccagatcggagtaaaccgggcaaaatctatgtctcccaaggcggttttctcgatgatgtttccaagtttgacccgcattttttcggtattgccccgaaagaagccctacacattgatcctcagcaacggttactgttagaagttgcttatgaagctttagaaaatgcaggcatggcaacaccaacggccagaatcggcaagacaggtgtttttattggtattactaacaatgattatgctcgcctaattgcaccggaggatgattatagtgccattggagcctatcatatttctggcaatcataccaatgccgctgcggggcgtatttcttatcttttgaatctcaatggccccagtttagcggtagatactgcttgttcttcttccttagtcgccgttcatctggcttgtcgttctttgcgttcccaagaatgtagacaagctttagtcggaggagttaacttaattttaactccagaagttccgattgccctatgtcgaaatcagatgttagcctccgatggaaaatgcaaaacctttgacgaaagtgccgatggttttggaattggtgaagggtgtggagttattgtcttaaaaagattgagtcaagccctagaagatggcgatcggatttgggctttaattcgaggaacagcagttaataatgatggcgccagtggaggctttacggttcccaatggtacgatccaaacagagttaattggtgaagctctgaccgatgcccggttaaatgcagatgcgattgattatgtcgaagctcacggcacaggcacatctttaggagacccgattgaaattaaagctatagctgatgctttatgcgtcaatcgctcaaaatctcaaccattattagtcggttctgttaaaacaaatctgggtcatctcgctgcggcggcagggatttcaggtttgattaaaactgtattatctatctactattcagaaattccagcccatcttaattttaataaccctaatcctcacattaattgggatattttacctatcaatatagttacaaaaagttgtccttggattgtcaacaatggtaaagataaatcggcggttgtgagttcttttggagcatcgggaaccaatgctagtgtaattttaagcgaacctcctcaagaccaacccctaatccccaaaacatccccgatattaattactttgtcagctaaagatccagaacggttgcggatttttgcttccgaattaattgctgatctggatcaaaaaccagatcggaatatcaatgatattgccttttctttaaataccggacgtttttcccataaacatcgactatctttattagtttctagtctggatagtttgcagaaagggctggaaatttttctgagtagtaatttggaagaaaaccagaaacaagtaatttatggagaggcgcaaagtaatcctaaaatcgcttttctctgcaatgatcaagaagaaatagttccgagaatgggagaagatttatttacaaatgagcctgtatttcatgatgcttttattaaatgcgatcgcctatttcaaaagcacttaaaattttccctagaagatttattatacaaaaatcaagccctagattctcaacatgatcctttatctgtacaacccatattatttgctttccactatgcactttgtgaactctggaaatcttggggaatttgccctgctgcggttttaggttcgggattaggtgaatatcttgccgcccaacaaacgggtgttttttccctagaagatgcagttaagttggtcgcaagtcgtgctcattttttatcgcaaaaactcgatcaaagagaattagcagattttcaaaaaatcgccgaagaagttacttatcaccagccccaactgaccttaattgctaatggtgaactggctaataaagctctgacaacttctgcttattggggacaacaattcaccgaaccaaagcaggttgctaaaggaattactaccctacatcaaatggggtatcaaatcttcctagaaattggaacttacccagatttaatcaatattggtcgtcaaaatttagctgaaaactcgatactttggttgtctagtttagtcaaagattgtcatagtaatcagcaaatgcaaattgttttgggagaactgtatatccgaggagtaaatattgactggaaaggatttcatcattcccatgcaggacgaaaaattagtttacccaattctccttttatccgcaaacgttactggataacttcagttaatcatcaacccaaagcaattagtaaaggtaataattattcctccggtcatcccttactaggtgatcgttttccttcgcctttatctgatcttcaatatcgagggagtattagccagcgtcaacccgcttttttacaagaacatcaagttttcaatcaatccatatttcccgggtctgcattgattgaaatggctttggctgctacacaaaatcaaactattatattagaaaatatacaattcaaaaaagcgttaattttaacaaataaagaagatatattacaattaattgtcactgataaaagttggcaaatttatcatcaagttgagcaaaattgggaaatcctggtgacaggggaaattgatcaatcaaaatcaattaattcaacggttgataacctagaaaaaataaaagtaaattgtccagaagaagttgagattaattccttttatcaaacttaccaaaaagcgggagttaattacggtagcaactttcagctaattgagcaacttaggaggggtaataatacggcttttgctcaaattaaattaacagatactctccgcttagaagcgaaaaaatatcattttcatcccgcgatgttggacgcttgctttcaggtgattgccgctattttattcaagcaagaatcatcggtaacttatgtacctgttcggattgctaaatttcaattttttcgcacccccgacgatattgtgattagtgctgcgcgactccagcaaaatcatgatcatcctcttatgattatctctgatattgatatctattccccccaaggtgaactgattgcatcaattataggcctagaactaaaacctgtacaatctcaagacattattcctcaagaaaatcaaccccaaacctacctagaagaatggattcctttagtaccattattagctaatgggagagatactttagtcactcctgatctgattaaagctcaaattcaacccgcgcaattagaacagcaattagcagacaaattaccccaatatgaacgcttactagaagcaatggaaagtttaagcgttacctatatttgggaagcattaaaacaactgaattggcaacccaaattaggtcaaacttaccccgaagaacagattgctattcaaggcgaaatagttgagttttatcgtcctttattatctcgatgcttagaaattttagctgaggaaaaaattgttacttggcaacaaaatggctggttattgacaaaagaattagaaaccctttcatctcaatcacaaattcaagatctccgccaacaatttcctgattattcagccgaaattaatctgatagaacgttgtggtttagctttagctgaagtcatgcgtcatcaaattgagccattagaattaatattccctcaaggagatataaatgcgatcgccttaatttattctgaagctgctggagctaaattaatgaatcagttagtagcagtaactattaactgtgctatcgctaatttaccaagcaatcatcagctaaggattctggaaattggcggcggaacaggagccactactgctgcaattttaccccatttgtctcccgaacaaattgaatatgtatttaccgatatttcctccagttttttaaatagagccaaggaaaataacaacaattattccttcattcaatatcaaactttagatatagaaaaaaatccctttaatcaaggttttttccccggaagttttgatattattattgctgctaacgttcttcatgccacagcagatattcaaaaaaccctggaaaatgtacgatctttaatcgctcccaatggattactgatactattagaaagtaccggagccagacgttgggtagatttaacgtttggcttaacggaaggctggtggttatgtagccaagaccctctccggcatggttatcctgtagttaatacagaagcttggcaaaatttactcactgagcatcaatttgcagagattaatattattgaacccagccaaccccaaacccgaaatctattaaaacaaagtgtgatcattgctaaaagtagcgacagattgatccctttccatgcaaaacctgactggaatcaaatcatctttgctgatacccaaggaattgctaacaatttaattcctccattacaacagcgaggcgttggttgttcaatgcttttccctgaagatattaatcctgattctgccgaagattacctatcagtattacaaacccttttaacaccagaaacccatcaaatattgtacttttggggattggaaaaaatagcaggagaaattgatcaagaagtagagattcattgtcaacggtttctgtttttattacaagcattattacaacaaaaaaatcccccagatctgattcttgtgactcaaggagccgtacctgcaaaagaaatcaaaactctaacttctcccgcccaatcttctctattaggaattgctttcagcttagtattagaacatccagaactcaattttagagccattgatttagaccctaacgaacaaaacttagcagaaaagttatttcgagaaatctacagcaataccccagaaaatcgtatcgctctgcggggtgaacaacgtttttgtccgcgtttagtacagcgaaaactcgcagcaggaaagatcaattttagtcccgatggctattatttaatttcaggaggaaccggaggtttagggttagctacggcccgatggatgatagaaaaaggcgcccgtcatttagttttgtgcagtcgcagtggtgcaaaagctattaaccctgaaaatttagcaagtttgcagtctaatcttgtcgatattaaaattaaagactgtgatgtgacagatgcagaaaaactgcatattttactagaagaatgccgttcagaatatccggtgcggggcatttttcatattgcgggaaccctagatgatacaacattactgcgactaacaccagagagttttaattatgttttagcaccgaaagtcaaaggaacttggttgctacataaactcaccttaaatgaccctttagatttctttgtttgttatacctctgctgtgtctttaattggctcggcaggacaggcaaatgccgccgctgccaatgcgtttgaagatgcttttatctattatcgtcaggcgaataatttaccaggaactgtgattaactgggggccttggagcgaaattggtgcggcagtagatcgtaatgttttagagagattagcctctaaaggttatgcagcaattaaacctaatttagctcttaataccctagaaaaaatcttatttaatcagattatccgcgcgggtgtaattactattgactggcaacgttttccttatattaaccaaaacttttatcaaaacttccgatctcaagccaaaccccaaacttctaatccatcttccgatattttaaaacaatggcaaaccctacctataaaacagcgtagtagttggttaattaatcatctgagtttgtgtgtatccaatattttaggacactcaaatgatgaaactattgctccccaacaaggattttttgatttaggaatggactctctcacctccacagaacttcgcaatcttttgcaaacagattttgattgttctctgccatcaactattgcatttcgttttcccaatgtggaaactttagccgattatttactgcgggaagtcttagatatttgtgaaccaatactaactcctattcccgaaaaaataccatcaaaaatccatcaaaaacaaattaaagaatctaccccagacaaaccacaaatagaagaagatccgattgtaattgtcggtatggcttgccaatttcctggcggtgctaataatttaaaatccttttgggaacttttagaacagggaaaagatgcagtcggagaaattcctgaaaatcgctgggatatgaaaatctggtatgatcccgatcccgataaagcaggtaaaatatactctccttatggtgcatttttagagcaaattgatcaatttgatgctgaatttttcggcattattcccagggaagcgatcgccatcgatcctcagcaacgtttactattagaaaccgcttggcaagcattagaaatgtcaggacaaaatccgcaaaaattacgcaatagtcaaacgggcgtttttattgggtgcatgactcaagattatgcccaattaagttattctccaaaggcaattaatgcctatacgggttcgggaacttctgttagtgtagtttccggtcggctttcttatatcctgggtttgcaaggcccatcaatgacaattgataccgcttgttcttcctcattagtggcagtaaatttagcttacaatgccttgcgaaatggtgagtgtgatctggctttagccgggggggttaatgttattattaccccagttatttctttaattgaaagtcgtgcccaaatgctggcacccgatggacattgtaagacctttgatgaaagtgcaaatggaatggtgcgaggcgaaggttgtggaataattgttctaaaaagattgagtcaagctattaagaatggcgaccatattttagccaaaatttatggtacagcagttaaccatgacggccccagtggtggattaacagtcccgaatggtgcagcgcaagaaaaattattatatcaagctctgaagacagcaaatctgcaaccagaacaaatagattatatcgaagctcatggtaccggaactgcccttggagatccgattgaattagaaagtatggcggcagtttttggtaaacgtcctccgaatcaacctttagttattggttctgtcaaaacaaatttaggacacttagaaggagcagcaggaattgccggattaattaaaacagttttagctttacaacaccataaaattcctccccatcttcactttaaaaaacccaaccctcggtttgattggagttctaatatttttgaagttcctgtaggcggaaaaacctggaatcccagtgaacgccaaggaattgccggggtaagttcctttggctttagtggaacaaatgctcatattattgtgggagaaattgactctagtttacctaaaaaatctgagcctaacttttacctattaccgctttcggctcgttctgaaaaatctctccaagagttaactaaaaattatcaaaatgctttgaatgggtctggcaattttgctgatgtttgttttacgggtactacaggacgggctatttttcagcatcgaatatgtattttagctgaatcaatgacaacagcacaagcagcactggttagtttccaaaaaggtgaggattctcaacaattaattacaccaattttatcagaaaacaagctaaaaatagcttttctattttcaggacaaggatcgcaatattcaggaatgggagaagccctttatcaccgagaacctgtctttaaaaatactttagatctttgtaatgaaatcctagaacctattttagaaaaatccctgttagatttaatctttaaattgcccaatagccagctattagaacagactcaaatcacccagcccgtgctattttcttttgaatatgcactggctaaattatggcaatcttggggaatagaaccttcagcacttttaggacatagtattggcgaatatgtagcagcttgtttagccggagttttctctttagaagatgctttaaaattagttacccaacggggtcggttaatgggagaactaccccagaatggcagtatgacagctatttatgctgattatgaaaccgtagtggcggcccttacttcctaccaaaatcaagttaatattggttcggctaatggctcaattacagtgatttccggggtaaatgacattgttgatcgactagagaaaatctttatagatcaaggctataaaactaaacgtttagccgtatctcatgctttccattctcctttaatggaaccaattcttgatgattttgctaaggttttagagaatatttcattgcataaacctagcttaacgattattagtaatatcacaggtaaacccatcggtcaagaaattgcgactcccgattattgggttaatcatcttaggagtacggtgcagtttagtcaagggtttcagttcttaattgatagtggttatcgctgttttctggaagttggttctaaacctgtattattgggtatggcgcgactaatttcgccaaatcaagaaatattatggctccctagtattgtacctggacaagatgaacaagcccaaatgtatagaagtttagcgacactttttgttaatggttattctgtagaatggacgcaggtatttaaacaaggaaaacggatttctttaccaacttatccatttcaacgagaacgttattggatatcaaattctgaattttctatccccgacataaaaactaatttacatccttttattcgggattttaaaaagttagctacgggggaaattgtatttgagggtgaaatcagttctgatcagccaaattatcttcaagaacacaaagtatttgaaaaagttttatttccagcgacaggatttatagaagcaattttagcagctagtcagaaaatattgcctgataatttgatcatccttcaaaatgtctcaattcatcaaggattattattatcggaaaccccaataatattacaaatgatttttaaaccccaaaaattatctaaacaaagctatagttttgaaatatttagtcataatcctacagtagatcaatggattcttcatgttactggtgaggttgaatctaataatttaaaaggagttgctgaatcagaatttaaaaaggatgcaacagaagaaggggaagcggtttctatttctcgattctctgaactttatcagcaaatgggaatcagctatggaaaaggatttcaagggattcaagaattattttctttaaaaaatggttctcaggctaagattagtattgaccacagtttagcagaccagcgttattgttttcatcctgtccttttagatgcttgcttgcaaagtattggtgcagctttttcggaaattcatggtcaagaattgcatttaccctatgggttttcttcattagaattattccgagatcctggtgatcaaagtttggcacaggttgatgttaaatctgattctcagggtgaaatgtgcgtagatgtagatatttataatcagcaaaaacagctttgcgctcgctttacaaacttaaaagcacggcggactaaaccagaaattttacagcgtttatggcaagaaactgagaaaaattgtttttatcaaattcaatggaaaaaactggatttactaccaactgttactaacaatcttaacaattcttggttaatatttgtgcatcctaaaacagcattaaatcccttgatcaatttattgaaaaaagcaggagaaaaagttataatagtagaaattggtaacaactatcaatgctactctcaagattattttgtgatcaattctgctgaaaatactgattttcagcgtctatatcaacaagcatatccgtcgggagaattgcccacaggcataattttttcttgggaaacagtatcatttgcagaagatacagagagcttttatacaagttgtcaggcggcattgaacttaattcaaactctaactaataactggcaaaaattacctgatttatggttaattactcgtggtgctaatcaagtattagaagatccttccttagaacctcaacaatcttatttatggggattaggagcagttattaatcaagaatatccccaaatgcgttgtgtatgtttagatttatcaacgactaaggaagctgaggaagctgagttattatttaatcaattgcatacttcaaataatgaattacgtctggctttacgtcagggaaactgttatggagctaggttagtttctgccccccccgtgcacggggggtttgggggggctattcccgcagcgcaaaaacagcaatttgtgagcaaagaaggagcttatttaattactggaggtttgggaaaactgggattattagtcgctgaatggttatcgaaaatgggggcgagtcacttagttttatgcagtcggaatatcaaatctcaacccgaattaattgcctcatttgccgaaaaaggaacagagattacaattatcagtattgatattagttctcccgtagagatggaacgattattctctcgttttggcaccgatttgccatgtttacgaggggtaattcatgctgctgctgtcttagatgatggacttttagttaatcaaaattggcaaaaatatcaaaacgtcatgcgtcctaaagtagaaggaactttattattagatcactatactcgccccctatctttagacttctttattagcttttcttctgctgccgtgattctgggttcacctggtcaaagtaattatgctgctgctaatgcttttatggatgctttaatgcagcaacgacaaagtttaggattaccaggaattagtattaattggggagcttggaatacagggaatgaaattgaacaacaacgttttgctaattgggggattaaaagtctgtctgctgatacggcttttaaatatctcaattcgttaattctaggtaacgttgtccaaggagtaattattgatattgactggtctatttttaaccaatcttttaatattaagcaacccttctttgccgaagtattaaccccaaaagcacaaaaaccagaaaattccgccaaattattacagaagttaaaatctatctccatagatgagcgaatccccactttatctcaaggaattgaacagatattacgcgaagttactgggttaaaagctaatcaagtcattcctcaacaaacatcatttttagacttaggcttaaactctctaatggtaatagaatttaaaaatcgcctagaaaatgatttaggttgcacattgtccgcctcaattatttttgattatcctaatatcttcagtttaagtgcctatctacgagcagaaatattagcgggcgatctcgattttgagatcaaaacagatgcaccaacagagtctctaaatccctatgatagtcttagtgaggaagaactggctatattacttaatcaaaagttaatcgagcttgactaatcaagcaaaatctgatacattgacaaaattagagataaacaaacaccagaagcctgcatggttcaaaatacagattataaaaaattaatcgcaacaactttaacaaaaatggaggtaatgcaggctcgtattaccgaattagaaactggacaaagggagcccattgctgttgttgggatgggatgtcgttttcctggtgggattacatctcccgaagaatattggaattattgtcaagctggacttgacgcgatcacagaagttcctaaaagtcgttgggatagctcaaaattttatgcaaaagaacctacaccgggaaaaataaacactgcttattgtggatttattcaacaggatattacagaatttgatgcccgtttcttttctatttcttcccgcgaagccacctcaatggaccctcaacaaaggttactattagaagtaacttgggaagcattagaaaatgccaatttaccaccgaataatttagcaaataacaccgtcggagtatttgttggaatcaccagtgttgataatgccattacggtttataatagtagttatgatcaaattgactctttttttggcacaggaaatgccctgagtgcagccgcaggcagactatcttatttcttcaatttaagggggccttgtctgtctattgatgcggcctgtgcgtcttctttggtagcagttcatcaagcaattcgtagcctcagaaatcgtgaatgtgaagtcgctttagttgccggggttaacctcattttaaatcccgcaattacgattaatctttcccagtcgggaatgttgtcccccgatggtcgctgcaaaacttttgatgcttctgctaatggctatgggcgtggagaagggtgtggggttttagtcttaaaaactttatcagaagcacagaaaaaaggcgatcgcattcttgccattctgcgggggtcggcggtcaatcataacggggccgccgccgggttgaccgttcccagtggcccggcgcaacaagaactgctccgtcaagccattgccgatgctagaattacccccgaagacgttgggtatatagaagctcatggcacgggaacttctttaggagacccgatagaaatgaatgcgatcgcttctgtttatggaaaacgatcacaacctctttatgtgggttccgtgaaaaccaatatcggacacctcgaagccgctgctgggatggcgggaattatcaagacaattctggtgcttcaaaagggtgaaatacctgcccatcttcactttcaaacccctaatcctctgattaattggcaggacaattctatcaagattccgacccaaactattccttggcctaatagcaacaaaattcctatggctggggtgagttccttcggtttttcgggaacaaatgcccatgtaattgttgaaaaagcacccgatataaaaataacagaaattaagcaaccccttcctagtcatctattaacaatttctgctcataacaaaaccgctttacaagaattagcccgacgtttttctacccgattagaatccgatccagaaataggagatatttgttatagtgtggcggtggggagagcaaagttatctgaacgtttagcaattgttgctaatactttgcccgaattacaacaaagattagtcgcttttgctgatcaaaatccccttgataatttgactttttatcaacgctttaccgaagaaaaacagcctaaagttgtctttttgtttacgggtcaaggtgcttgttatccggggatgggtgatcaactataccaaactgaacccacatttcgtcaatatattgatcaatgtgcagaaattttagccagatatttagagtatccgttaccagaaatattatttggtaaacacaccgatttactaaatcaaactgcctacgctcaacccgccatatttgccctagaatatgccgttgctatgctttggaaatcttggggaatcacacccagtttactgattggacatagcgttggggaatatgtagccgcttgcatcgccggagtatttagcttagaagcaggactagcattaattgtgaaacggggtcaattaatgcaaaccacaaaaataggaaaaatggcttcgattttcgccgatgaagctacggtaatttctctaattcaaaactatagtaataccgttgccattgctgctattaatcatcctcaacaaattgttatttctggagaaagtgccagtattgaggaaattattattaactgtaaacagcaaaaaattgcggctcaatatctctccgttactcaagcttttcattctccgttaatggagtcaattttaaatgaatttgaacaggaagcccctggtcaaatttcttaccatcgcccccaaattctgttactttcaggaattgacggaaaaattttagaaaatgcccctgatgcgagttattggagacagcaatgccgtcaacctgtacaatttttagcaagtttaaacacggcattaaataaagggtataatctgtttttagaagtcggttcaagaccaatactagcagaacaggggcgtcgttatcaggatggagctatctggctgagttcactgaatcgaggtttagatatctggcagacaatactctcggcactgggtcaactgtacctcaatggagtctattttaacccggaaaaatttaatcaaaattatggatataaacaagtaagattacctaattatccctttcaaagaaaacggtttcaatttcaacctaatattgtggaggaaactacccaaattacagaaatatatcccgaaccagaaacgaataaaatcactgaactaaaggtacaaaatatgcaaaaacatcaactcgaaatccgccagcaattaaagtctattcttgcccttctgctcaaagaaaatcaaaatgatattcgggatgatgaaaccctattaaatctaggggcagactctattattttaacagatttttctcgcaaagttgaagaaaagtttaaagtaaaagtcaaaatagatcagttattcactgacttacaaaccattgccgatatcgctgaatatatctataattctattgaaccaaaaaacttagaaccttcttcagaaaagactaaattaaatcaagctgaaattgtcaattttgacccagaaataaataattatatagaagtcatttctcaattacaacctattgcaactgcttatattattaaagcattagaaactttaggaaaaaaactaaatcctggagaaacctggacaacagaaagcatcaagcaaaccttacccattgccccaaaatatcaggttttagttactcgttatttacaggatttagagcaagctaatattattcaaaatcaaggtaatatctggacagttaaaaacttacctgcatctttttccttaccagaagctatagaaaatctgcaaaaaacttgtccatcggcaaaaccggaattagaaatgctgcaacgctgcggagaaaatttagcagaagttctcaaaggaaatatagaccctttaacgttaattttcccagaaggttcagttactcatgccgaaagtatctacggaaattctcctgtctctcgtttgatgaatcaacgggtagctgaggcaattaacctaactttaaataatttttctcccagtattaacccttataaaattatcgaaatcggagggggaactggagccacttctgaaacaattcttaataacttaaatctcaatcgggtcagctattcttttagcgaattatctccatttttacttaatcaagctcgtcaaaaatttcagagcaaatataacctcaactttcatcaattagacattgaaaaatcaccaatttctcaaggaatatcctcccattcttatcacatagtcgttgcagctaatgttcttcatgctacccaaaatattacagaaaccctgactaatattagagagctactgctccccggtggttacttaatcctactcgaaaccgtcgagaataattcctggcttaatttaacctttggattgacccctggatggtggcgtttccaagacaaagaattacgttcagatacgcctttattgagtggagaaagttggtgttctgttttaaaacgctgcggttttgccactgccaatagtttttctaaacaaaataatattagtatttataatggccaagaattaattattgcttgtgctgctgctgaaatattaccgattccccaaacgcctaaagcaacccaattccaagccgtaacctctggcaaagaagccttgatgatggctcaattgcaatctttaaaagacctaaaagatctccatgaaaaaaccattatcaagcaattagaaatccttcaatccgtagggattacacccaatattatcaccgaaaaaccaataattcaaacagaaattattccatctcaaaattatcaaatagaaacagtatctcctgctcaacgagagcaaactaaattacctcaaaaaccaagttctcccagtttaaatcccctagcattaaagctaaatgagagtaaatctttaaccgaaaaacagcaggattttatcaacaatctccagactatttataaccaaaaaactgcaaaatcaaaagcctattcccaaaatagccgtcaaacaatggttgatgtcaaacccaccattgactttcggatgacattaaaagaatttcagtatcccattgtctcagaatcagcccaaggagcctgttttcgtgacattgatggcaatgattatattgacttagctatgggatttggggttaacttttttgggcatagtcctgattttgtcatagcagcagttcaggaacaaatgcagcaaggaatcggattaggaatgcagtctaatctggccgcagaaacggcagctttaattagtgaaatggccggggtagaaagggtggcttttagtaatactggaaccgaagcaattatggcggccgttcggattgctcgttctcgcacaaaacgcccaaaaattgttatattttccggctcctatcatggcacttttgacggcattctagcgcgagtgggagaggattcaaccagcattcccgtaagtctgggtacaccatcaggaatggttgaagatgtaattgttttgagttatggagtcgaagaaagtttagaaattattgcggctcatagtgatgatttagcagcagtattagtagaacctgttcaaagtcgtaaacccgatttacaacctcaagaatttctgcaaaagttaagaaaattaactcaggaaaaagggattgcactgatttttgatgaaattattacgggatttaggattgctcctggaggggcgcaacaatggttcaatattgaggcagatatcgttatttacggtaaggcaattggtgggggtttacctatcagtatgatttgcggaaaagcagatttctcagataccgttgatggtggtttctggaaatacggtgatgactcccacccccaaacagaattaaccgcttttggaggaactttctgtcgtcatcctttggcactggcagcttgtcgcgcggtgcttttatatcttaaagaacaaagtccaaccattcaggaacgggtaaatcaattaacccaaagattagcgactgaggtaaatcagttctttcaagaaataggaattcccattcgcattgttaattttggttctttgtttcgctttgaaccttttggagcctatagtcttttcctacaacctattgaattacctttgttttattacttgttaaatcttaaaggtatttatacatgggaaaaacgagtttgtttcctttctacctgccatacaaatgaagatatagataaagttatagctacggtaaaatcagcaattattgaattacagcaagggggtttttttgaaaatgccaaacttctaaaagtaaataagcaagataaaaatgttgagcgcgaagatgaagatgggagggaaaatttaaacccaataaatcagcaatttcctaccagtgaagcccagcgtcagctttggttattagcagaattagatagaaatgcttccgcctcctataatgtcacggcttctttagagttaaggggttctttagatatttcagctttacaagaagcgattaatcaagttatcaatcgtcacgaatctttgcgaactcaaatattagaacaaggggaagtacaagaagttattaatagcgtcaaaattcagttaaccttaattaatttgaacgatgaacagaatcctcaagcaatggctttaggattaagatctcagttttctaaaaagccttttgacttgtctatagctcctttatttgatgttatcttaatccgcttaaactctgaccattacctgttatctttaaaaacccatcatatcgttgtagatggttggtcactagggttaattttgaatgaaattggtcaactttattccacccaaattggtgctactacagaccctttagaattcccaatgcagtttcgccagtatttagctttacgagagcaagaagcgcaaagtccacagatgttagagcatcgtgatttttggttaaaaacctatcagggagaaattcccgcctttgagcttcccaccgactttccccgtccagcaattaaaacttacactggaggtcaagaaagtaaaattgttacacctgaactttggcaaaatttacaaactgtaggacgccaaaatcaagcaacattatttatgacaatgttcgccgcctacacagcttttttaagccgaatttctggccataatgatttagtcattgggattcccatttcgggacgacaaatagaaggtagtgaccaattagttggtttttgttcacaatttttaccgattcggattaaagtagatatcacccattcttttgttgaacatttgcaacggactaaacagacactcatcgctgcttttagacatcaaagttacactttagaagatttgttagccgccttacaattacaacgggatttttcccgttctcctctaatttcagtatcttttaatatagaccctagtttaactctacctgattttgagggattaaaagtatccctgccaccagaaccaattggttacactcctttcgacgtcggatttaactttattgaagtcaataataacctgattatttactgtaattataatacagaactgtttaaacaagagacaattaaacagtttctcgaaagttttgaaattttgttagatggggtaattaataatgccaatagttggctccatcagttacctttattaaccaaattacaacgggaaaacttactagctgagttaatcggagaaaccagagaattacctgaaaatgctaccatcattgatgattttgtttctcaagttaactcgactcccaatgcccccgccttagtttgtggagaaaccactcttacctatcaagaattgaatcaaaaagttaatcgtttaacccattatctacaacatcaatatcagctaggtgcaggcaaaataatggggctaatgatgggacggaatcaaaacctaattattagcatcctggcaatttttaaaaccggggcaacctatgttcccatagatgccgaatatccgaataatcgcatagattttattatcaaagatagtggttgtcatgtttgtctaactgagagtaatttgatctccagaattcctcaagaaatagagacaatttgcttagataaaattgataatattttagcaaaatatggcaatcaagagcctaatattccaccggattctagccaaattgcttatattttctatacttctggttccacaggaaatcctaaaggagtcatgggtcgtcatctctctattttgaacgtaattcagagtttacgactcacctttaatttagataaatatcctgaatggcgctatatttttacggctgctgtcactcacgacccatctattcgtaatatttttctacctttaacaataggcgctcctttatatatttacgaagtcaaatatatcggacatttagtttcttttttacaggaaaatcaaattaacgcgctccacacaacaccatctatttatcgagaaattttagctttactcgaaccaggagaaactatctctagcttaaaatatatttccgtagggggagagaaattagatcgagaaacagcactagctttacgccaactttttccaggagaaattgttagtaatgtttatggttcaacagaaacttgtgtcggagtatctcaatacaaaatcaacgaaaatttagatacagacgtacccctaggtcaagttttccataataaccggctatttctccttgatgaatttaataatccagttcctctgcatatagttggggaaatttgtgtcgaaggtgcagccttagcatcgggttatcacaatcttcctcaaatcacaaaagaaaaatttaaacctggcttttttgatcagaaaacaacgatgtttagaaccggggatttagggaaacaaactgctcccggtgtgattgaatttatgggcagaaaagacaatcaagttaaggtaaatggctatcgtatcgaccccgaagaaattgaatatcaacttaatcgttatcctcagattgagagagctattattctaccgatatcagtcaataatcaaactcaattatcagcctattgtcaaacagataaacagatagaaatttctgaaattagagaatttctagctaattttttgccagtttacatgattcctagttactttattttcttaaagcaatttcccctaactaaacacggcaaacttgacttaaactcaatgattgcactcaatgaaaccgggaaatctacccaagtaaattatgttgcaccgcgtaataatttagagtcaaacctagttagaatctgggaaaagattctaaccaaacatcccatcggtatttttgataacttctttgaaattggcggacattctctgatgctttcgagaatcgtaacccacgtccataaagaattaaatgtatcggtaaaattggctgacttctttaaagttcctaccatcgccggattagccgttttagtctctaaaactgaatatgattatcaagaacccatccccacaattcctctgcaaaaatcctatccgatgtcccatgggcaacgtcgtctttgggcattagaatttcttgatcaaaatcataatgcctatggaatgcccagtgtttatcaatttaacggcaatctgaatattgcggcttttgaaaatgcttttcaacagttaattcaacgccacgaaattttgcgaactacctttagcttaatagataatcaaccgcgccaagttgtacacaatcaaatgaattttggtattaaacaaatagacttaacaaattatttagaaacagaacaagctaaactgattgctgaagcgatttcccataatgccaaaactacttttgatttagaagtagggccgttactccgagttaacttactcaaactaagtcaagagaattatatcgttttatttaatatgcaccatatcatttctgatggttggtcagccggggttttaattaaagatttcctagggcattatcatacatatcgacaacaaaattcagagttactaccccctctaaaaattcactataaagattatactgactggcaagaaaatcagctaaaaacgtcgaaacttcaagctcaacgtgattactggttaactaagttaactccggctcctcaacatcttaacttgccttttgattatcctcgacccgccgttcaaagttttcaaggaaatacggtgatctggaaacccaattcagaactaatcgagcattttcagatattaattaaagataaagaagctagtttatttatggggttgctgactttagttaagagttttttgtttcgttataccgaacaaaatgagattacagtaggttctcccattgcgggcagaaatcatcccgatttagaatcacaaattggtttttatgtcaatactttagtcctgcgggatcaaattagagcagatgacagttttttgaatgttttaaccacagtaaaaaccaccacattagaggcttatgaaaatcaagaatatccttttgataaaatagtttcagatctaaatttaccgcgtgatcctagtagaaataccctctttgatgtggcggttgccctccaaaataatcaaaatgtagacctcgcactagaaggaattacagttaactccattgacccagagatgactacagctaaatttgatttagaattcatttttgttgaggaaggagaattatacttgaagctaatctacaatacagatatatttattaatgagcgaattttattgatgatcaacttattagaaaatctgatggagcaagtgataaaataccctgacaaaccattgatcaagctatctttagaatcaagcaattttggccaagaatatagcgacttattcgctgaagattttaatttctaggcaagggatggaatattaccatcgaaatttatcaaataaatttataaattaaaatcaagtacattgctctgtacggcagggtgataagtacctaaacaaaattaattacacatcctctaccctgttccctccccccctagccccccgtgcacggggggtttggggggggctgttccctctctcaactaggtaatttattttgtgcaactacttactatggtaaactcaattttatggaaaaacataggaaggaaaaatgtttaaacattcaatcagttctggagggcaattaaaagataattggcggacactttcagcagtcttagccaatgctgctaaatatgaaaatcagggaattccctatattggaaatgatgtaaccgaatattttcagacttatcaagatttatataatgatgctctcaatattttagatgggcttgatcagcgtgggatcaagttgggagataaagttatcttacaaattgctaaaaataaagattttattcccgcactctgggcttgttttctaggaggaattattccagtacctctgaccgttgcccctcattatgaactagaaaactcggcagttaaaaaactggaaaatgtctggaaaattttagaacaaccattaattttatccgataatgaattaattactgaaatccaaaaattagaaactcaatctcatctgaaaggattgcaagtagtctcaattgattatctaagatctatagaatctcaatcaaattcccaacccgataaaacatctaaaaaatgttattcattacctgatcttaccccagaaaatcaagccttattactatttacttctggcagtacagggatgccaaaaggggtgatgttaactcataataatctgttatccatgtctgctggaacagtggcaatgaataactttagccaacaagaagttaccctgaattggatgcccttagaccatgcaggagccatcgtctttttaggaattatggcggtggatttagcttgtgatcaaatccatgttccgatggaattaattttacgtcaacccctgaaatggttagagctaattcaaaaccatcaagcgactatttcttgggctcctaactttgcattttccttaattaatcaacagtctgaacaacttaatcaatcttcttataatctctcctccatgaaatttttagtcaatgctggagagcaagtttctattaaaactatccgcctatttttagaaattctcgaaaaacatcaattaccagatagagccattaaaccagcatttgggatgacggaatcctgttctggaattacttggtctgttggtttaagccaagataaactaacagaagaaaacattattatttctctgggaaagccaattccaggggctactattcgcattgtcgatcaagagaataatgttttaccagaagccgagattggacgacttcaaatcaaaggaaaatctgtcactaaagaatattatcacaatcccgaactgaatcaagaagtttttcaggatgaaggttggtttaccacaggagatttagcctatttattggatggagaactctttatcacagggagagaaaaacaagaaattattattaatggaattaattactttgcccatgaaattgaaacagtaatagaagaattagagggagtaaatgtttcctatacggcagcattcgccctctttgatcaaatccaagagactgacttattaattattatttttagtccagaatcagaacattttgagcaatgggtaaaagtcgttagaaaaattcgcagtcatttaactcaaaaagtcggaattgctccagcttatgtgattcctttagagaccaatttagttcccaaaacctctattggtaaagtccaaaaatcaaaattaaaaaaagattttgaacagggattatttgctggtcggattcaagaaattaatcaatatttagagagcgatcgccagaaaaaccgcagcttaccccaatcggaaaatgagcgtcaaatagcaacagtttggtgtgaagttttacaattaacttccgtgggtttaaacgataacttttttgaactagggggacattctctacacttaattcgagtacacaaccaactagaaaaactttttaatcgtcagttacctatagctgaaatgtttaaaaattccaccgttgccaccttagcccgtttcttaagtaaagaatcaaattccaccccagcaacgcaacaaaaaagccgtcaacgggctgaaaatcgctcccgtcgtcaacaggaaacccatgatattgcaattattggcatggctggacgatttcctggcgccaacaatctcacaactttctgggaaaatctgcaaaatggagtcgaaaccatctctttctttactgaggaagagctattagaatcgggggtttctcctgaactatttaatcagcctaattatattagagccagaccaattatcgaccaagttgaatattttgatagcgaattttttggatacacaaaccgagaagcagaattgcttgatcctcaacaacgtttattcctacaatcgagttgggaatgtttagaaaatgctggttataatcctaactcctatcaaggagcaattggcatatttgctggggcaagtatgaacacatatttaattaacaattgctatccaaatcgcggtcaattagatagtaatgatgaattacaacccttcacattagattcgatgggggggtttcaaacaatggtagctaatgacaaagattatttaaccacaagaatttcttataaactaaacttacgcgggccaagtattaatattcaaacagcttgttctacaggattagttgtagtccatctggcttgccagagtctaattaatggagaaagtgatatggctttagcgggagccgcttcaattaactcgccgcaaaaaattggttatttatatcaagaaggtttaattctttccaacgatgggcattgtcgtgcctttgattctcaagcccaaggaactatttttggaagtggagtcggggtggttttactaaaaagattaccagatgctttagccgataatgatcaaatttatgccgttattaaaggctctgctattaataatgatggggggacaaaattgggattcactgcccccggaggagaaggtcaaatttcagtggcagccgaagctttagcctttgctggtgttgatgcaaatacgattagttttatcgaagctcatggtacaggaacaaccctgggagaccccatcgaagttgatgctttagctaaagcttatggtgcggcaaatcagggagaatgtgctttatgttcgggcaaaacaaatatcggacatatgccaattgcctccggttgtgggttaattaaagcaactttagccctcaaacatcaaattattcccccgacattacatttccaaaatcccaatcctcaaattgatttttctaagactcctttttatattaatactgaagccataccttggaaaactaaacaacaaaatggacaagaattgcctcgacgggcgggggttaattccctaggaattggaggggttaatgctcatattatcttagaagaagctcctacgattattccccaacaaaatcaaactaaacggccgattaatttactcacaatttctgccagaaccccacaggctttaaaagatttagccaatagctatgtagaattttgggaaaatcaccccgaaagtgatatttctgatgtcgtttttaccgctaatacgggtcgagttcacttctcaaatcgtttagcagtaataggctccgaaaacagcgattttatcacgaaattacgtcagtttggacaactagatcaagggttaattattcagggtcaagttgatgaaaagcaaccgccaaaaattgcctttttgttcacaggacaaggttctcaatatgcgggaatggcgcatcaactttatcaaactcaacctacttttcggcaaaccttagagcaaggggaaagcatctatcaaaaactaacaggtaaatccttactagaaattatatttgctaattccgatgaaatcttaactcaaacctcctatacccagcccgctttatttataattgaagttgctttagctcaattatggcagtcttggggaattgaaccgatcgctattttaggacacagtttaggagaatatgctgctgcttgttttgctggggtttttgatcttgaaagtggcttaaaactggtgatcaatcgaggtcgtcttatcggtcaatttcctgataatcaaggagcaatggccgctattttcctagatcaaaaatcagttcttgaacagtgccaaaatcagggaataaaaattgcgatcgctgccattaataccgatcaacataccgttatttcaggggataaaaaatcaattcaacaactttgtgaacactttaataatacaggaattaaagttcgccaactcaaagtttcccatgcctttcactcccccttaatagaaccaatttgtgaacaattcaaaaccattctacaggaaattacttttgctcaaccccaaattcccctaatctctaacctaacgggagaaattgccgatgatagtattattactcccgaatattggctgcaacacttattacataccgtacaatttcatcaaggagttttgtctctccaatccctaggatgtgatacttttattgaaatcggcccccaacccattcttttaggtattattcaatcatcaatatcttcatctaaccccctaatattaccaagtttgcgctcaggattttctgattgggaagtcctattagaaagtctgggtaaactttatgttcgtggtttagatattgattggtttagctttaacaaagattatcattgtagccgatgttctttaccgacttatccttttcaacaaagccgccattggattcccttaaaaactcaattaccaacggttactcaagaatctagtttggtcaagatgttatctaataaaaatactaagagcttgatgcaaacccttttagaaacagggaattattctgaaacagaaaaacaaacggtatcggctattgttcaacaattaattcaacttcatcatcaacagacaaataattttgattttgaaaacctactctatcaggtaaaatggttccccgataatttagcaactcaaaaatcagaaaatctcgcaacaattcaagcggatttagatgtttatatggaaaaacaaatacaattcgcatcattaacaggagtttctttagcttttgctgaaatggaaaaactcagtgtagattttattattaaagccttaaaagatttagaactctttcaactcaatacactgctttcccccgacgacagttttagtcaagctgggattaaagcagaatataaattactctggaatcattgtttcaaaatcttagcagaaacaggcattttagaaaagcaggattctggctggaaaatcatcaataaaccgcaacaatcccatccagatttaacagtagaaaacttaattaatcaatatccaaatgctctaatagaactcaccctatttcagcgagttgctgctaatttagccgccatcctgacaggaaaaattgcgcctttatctatcttattttctcaaaatgaaaaaatcggagccgccgaattttataaaaacacatcctgggcaaaagttctcaacctgagtatctctaaagctgttgaacttttattatccaactattcaccctccgaacccctccgtattctcgaaattggcgccggaaccggagcaactacccatcaagttcttaacgcttgtaagtccgatcaaattaactatacatttaccgatgtttcaccattctttctggagactgctagagagaattttactcaatttcctaacatcaactaccaagttctcgacatagaaaaagacccgaaatcccaaggattttccctcaattcctatgatttaattattgcggctaatgtcttgcattctacgcgagatttacaagcagaaaccttacctcatattcaaagtttactgcgtcccggcggtcaattactattactagaactgactcatcagtctaaatggattgatttgattttcggtattacccaaggttggtggcgttttagcgatgatcatttacgctcccatcatcccattattagcgcatctacttggcaatctattctgcttaaatctggatttgctcaagcggaatttgtatctcccgatcaaaaaattggcagtgctttattccagcaaagtattattattgctcaaaatcctagacaagccagtaatatttcagaaaattggttaatttttaccgatagtcaccccgaaaaagatcatcttccccgtttcattcaagcgcaactaagcaaaaattatggctcctgtacgataatttatcaaggacaaaacaagattaaattatcacaattcgagtatagtttaaatgcccatcaaccagaacaaataaaggcatggtttgcggaaaatccatcgccccatagaattatttatcttttgaatgataatcatcaagatcaacctgaatctattttattaaatcgctgtcactatttgttaaatcttctccaagctattcaaaaaatccctaattctcccaaattatttgttgttacccaaggaggtcaaccctttgaactcaaacagcccacttttgttacccagtctccactttgggccttggggcgggttatttccttagaaaacccagaattatggggaggaatgatcgatcttgaccccagcgccgatattactcaaaatattgctgatttactattaggattgacccattccatcagcgaagatcatctgctattccgcaatggccaagcctatctggggcgtctagtcccatcgacatctccaccgacaaaaccattgactattcaagctgaagcgacctatttgattaccggaggtattggtcatctcggtttggccctggctggtcatttggttgatttaggggcaaaacatctgattttgaccacccgtcgcccctttcccccgagttcagaaatatccacagaatttgccaaaatcatggaaaatctcaggattttagagcaaaaaggagtatctgtcgaagtttgtcaagctgacgtcggggattttgagcagatacaagcaatatgggccaaaatcgaaaaaacagcctatcccctacgcggggttttccatcttgctggagtttcaggacgccaagcgcaattaagcgaatgtacatttgctgatctcgaaatagtttttcaagcaaaagttcgaggttcttggaatttacatcggttatctttagcaactaaattagactattttgtgctattttcttcggcgggtgcaatttggggagccaaagcacaaggtttatatgatgcagttagtaattcaatggattctttagctcttatgcgtcatcttcaaggattacctgctactactttaaattgggcattattagcaggaaatgggattgtttccccagactatgaagattggcttaaacagattggtatgaaggaaattgacctagatagggcgttttctgtaatggatgctattattgagtctaatcaaacacaaattttagttgctgatgtagattgggttcgcttcaaaaatatctatgaatttcaaggcgataaaccccttctgaaaaaattaggacaatctcaaaatataattaaatctgttcaagattcaagttctacacgccgtcttttagaagatatagcaccaggagaacgtcgagaacatttatttcaatatattggcaaacaagtggggatgattttgggaattaaacaaatgcctgacccggaacaaggattctcagaaatggggattgattctttgttgtctatcgaattaaaaaatcgtttagaaaaaggattagaagtgactttacctgcttctttagtttttgattttcccaatattagacgattagttgattatctgattcagcaggttttaggttggcaagttcagacaatagtgcagaccactgttgattctacagaagttcagcaggatgtcgatgcagatttaattttgcgagaactttctgaattggaggactttttaagtgattaaatcagccaaattataatatgctggaaattgtcaaccactttcaagatattgaattaaaactactccgctcccaccgagacaactactctatctgtaaaatatgcaaactcaagtttcgagccaacaacccttagctaattttaataaattttgggatgctttaaaagttatttctggatcttattggtatccaacagaccccaaaggacgaagtttttcagaagtaatccgctcctggggaatgctgattcttctggtattattaattattggacttgtggctgccaatgcagctaatagctttgttaatcgctatttagtcgatgttattattcaggataaagatacttctaaattttttacgcttgtatcactttacggtttggggctgttgttaattaccttatttatagcattttctaaatttgtcaaaaaaagaattgctcttaattggtatgaatggcttaatcagcagattttagaaaaatatttgagtaatcgcgcctattataaaatcaattttagatcggatgtggataacccggatcaacgtctggctcaagaaatcgaacccattgccagaaatgccctcaattttgccactaccttgttagaaaaagtcctagaaatgacgacttttttaattattcttttgtcgatttctaaactagccgcagctattttgctggcctatacaatcatcggtaatttaattgccctaaatttaagtaaagaattagataggattactcaagaggaacttgaatctaaagctaactatgcttacggcttaactcatgttcggaatcatgctgaatctattgctttttttcaaggtgaaaatcaagaattaaacattatttatcgccgatttaataatttgttaaaaagttctctaagcaaaactgattgggagagaaatcaagacctttttagcagaggctatcggtctattatccaaatatttccatttatcgtcttcgctcccgcctatattcgcggagaaattgatttcggacaagttaaccaagctattatcgcttgcagtatgtttgctaatggttttagtgaattaatcaatgaatttgggtcttctggacggttttctagttatgttgaccgtttatctgaattttcgcaagccttagaagttgttactcaacaaccaaccgatgttagtaccataaaaactatcgaaaaaaaccatattacttttgaggatgttaccctacaaacacccgattatgaaaaggtaattgtcaaaaatttatcattatctattgcaccaggagaaggtttattaattgttggccccagtggtcggggtaaaagttctttattaagggcaattgctggtttgtggaatgctggaactggtcgattaattcggccttccttagaacaatttctgtttttaccacaacgtccttatataattttaggaaccttacgagaacagttactttatcctaaaaataatcgtcaaatgagtgattccgaactggaagggattttacaacaagttaatcttcaaaatgtggtgacaaaagttgatagctttgatgcggaagtgccttgggaaaatatattatcattaggagaacaacaacgcctagcttttgcccgattcttagttacccatcccagctatgttattttagatgaagccaccagtgctttggacttgaaaaatgaagaacttttgtatcaacagttgcaacaaacccaaacaacgtttatcagtgtaggacatcgagaaagtttgtttaactatcatcaatgggttttagaactttcagaagattctagttggcgacttgcttctatctctgattatcaaactctcaaacattaaggtttgatctcgcctttttgaatttcaccctcttaaaccaaaaatactatttatggaaaagtttagagaagttacggaaacccatcttgttgccacagattaccaaattcggcaacttcgagaaatccagccagtcacacctttatttaatagtataagtcaaaataaaaccgaacataaagacaaaataattgctcctatatctatcaatttacgcgaccagatatacaatttaactgccaaaaatttggttaacaagttagctttatacctagcagctattcaatttttaatcttaaaatacacggcccaagaagaatttgttttagcaacgggagccttaaatatagaaacatctgatagcttaattttttgccgattcaatcaacaaaacttgaaatcatttaaggatttacttaaaatcactcgcagtcatcttcaagagggataccgccatcaaaattatgatctaaatagtctaatagaaacgtttttggccagaggcggaaatctcgaaaccatttttgatattgtagtgattcaagggggattttctagccacagttctttattgaacaaatttcaattagtttttgaaattgaggcaaccgatagttccgtttctgttactttttccccagatacttttcaggaagattttgttcaaaggatgctaggacattttctacaaattctggaaattgtaacgattaatcccgatgtggagttgagagaaatagatatccttacccctggtgaacgggagcaattattgataaaatggaataatacccaaactgaatatccagccgataaatgtattcatcagttatttgaagaacaagcaaaacgcactcccaatgccatcgcagtagtctatgaaaatgaatccctaacttaccaggaattgaataatcgtggcaaccaattagcccataatctccaaaaattaggagttaaaccagatactttagtgggtatttgcttggagcgttccctagaattagtcgtagggttattagccattttaaaagcggggggagcctacgtcccgattgatccccattatccccaggaacgcctcacctatctattagcagatacccaagtcaaaatattactcacaagtcaatctcttacatccttgttaccggctaatctagctaaaattatctgcttagatagtgattgggatctcattgcaaaggaaaatccagacaattttgagagtggggttacggtagagaatttagcctatgttatctatacatcgggttcaacgggacaacccaaaggcgcgatgaattgccatcgaggcgttgtcaatcgtttgctgtggatgcaggatacctatccattaacccagggcgatcgcattcttcaaaaaaccccctttagttttgatgtttcggtctgggaattcttttgcccgttattaacaggggcgagactggtggtagccaaacccgaaggtcataaggacagtgtttatttaattaaactcattcaagatcaacaaattacaaccctacattttgtcccctcaatgctgcgggtactgttacaagaagcggatctagaaaagtgtcagagtttaaaacgggtgatttgtagtggcgaggctttacctaatgatctaagccaacgtttttttgaacgtttcaactgtgaacttcataatctttatggcccaacggaagcggctattgatgtcacctattgggcttgctcaccgaattggaaaagagaggtcgttcccattggtcgccctgtcgccaatacccaaatttatcttcttaatgccgatctccagcccgttcccatcggcgtggtgggggagttacacattggcggtgtgcaattggcccggggttatttcaatcgtcctgaattgacggcggaaaagtttattgccaatccattttatccttcccttcaaaaagagcaaggttcgaccatctcgccccgactttataaaacgggagatttagcccggtatctccccgatggcaatattgaatttttgggacggttggatcatcaggttaaaattcggggttttcggattgaattgggcgaaattgaaactattcttggtcaacatcccgatgtctgccaatccgttgtgttggcccatcagacggaaacgggtagccaaaccctgattgcctatgtggttagtcaatctcaaactaggcaacacctgtccccagaacaggaaccccatttctttgatgaacaaatcgggcagtggcaaaccctttataaccagacctatcgccaaagtgttgaggactcaaatcccctatttaataccgtcggttggaacagtagttatacaggagaacccattcccgctgccgaaatggatgaatggcttaaggataaaacagcaacgattctggcccaccgaccgcaacgggttttggaaattggttgtggaacgggactgatcctatttcaagtggctccccactgcgatcgctattggggaaccgatatttctgtggtgggactcgatttgattcggcatcacttaggggaatcgaagttagatttagccgagcaggttaacttattgcaacgccctgcggacgattttgaaggcttagaagccgaagcctttgacacaattattcttaattccgtcgtccagtattttccccatattgactatcttgttaaagttctcgaaaaggcgatcgcggcgatcgcacctgggggtcgtatttttctcggagatgtccgcaacctaaaactcttagcagccttccatgcttcagtggaactgaccaaagctgacccagatatctccgtcgatcaatggcaaaaacgagtagagcgacagattgctcaggaacaggaactgctcattgatcccgccttctttacagcactgcaacagcgttttccccaaattacccaggtggacattcaattaccccgcagtcagtacgagaatgagttaacccaattccgctataacgtcgttcttcagatcaacaccaaagcagaagtcgagcaatcagaaacatggttagcccaagaagctttcaccatccctgaattgtcccatttactagagaaaactcaacccccagtcgttggcattaaagggctgactaatcttaaattggtggctcctttaaccatcctagaatttttcaaacatccccaggacgttcaaaccgtcgaaactttgcagtcaagtttgcaaaagcttgtccttcctaacccagaaaccgagcttgaccaactggccgaaacctttggctactctctgctcctgacctatgctgatagtcaaacgttaaaccactacgacgcgatttttgtgaaggagcaaagacgaaagcctcatcgggcaaagcttactaacttatcaaagactcaccaagactggcaacaatacgccaaccatccgctccaacctcaattaaaccgtcaactcatcccccaacttcgtagttacctggaaactcgcctaccagagtacatgatacccaatgcctttgtgctgttagcagaaattcccctaacgcctaatggcaaactggatcgtcgagccttaccgtctcctgaacaaattcgcctggaactaaccgatacttttgttgctccctgtactccaattgaagaaatgttggctttaatttgggctgaaattttggggttagaacagatcggcattcacgataacttctttgaattaggcggtgattccattcgaggcattcaggtcattgctaaggctcgaacaatgggttttgagttttctttacctgaattattacaacatcaaacgattcaggaattagcccatttagtcagtcgtgaattaaatcccgtaacgtcccaaaaaacagaagtttttagtctaatttctgcggcccaacgtctcagtttacctccagatattgaagatgcttaccccctaactgccttacaattaggcatgatcttccacagtgaatatcaaggaaatgtgcctgtttaccacgacgtttttacctaccatattcgcactgtttttaattatacagttttacaccagactatccaagaaattgctgctcgtcatggcattttacgaacaagttttgccctcacagactatgccgaacctctccagttagtccaccatcaagtagagattcccttagccttagcggatctgagttccctcactagcctagaacaagaagccgccctagatgactggattgaaagggaaaaaagccatccctttgattggcaagttccgcctttactacgttttcatatccatcttcgcagtacagaaacctttaatttaacgttgagttttcaccactctattttagatggttggagtgtggcttccttactgacagaattgttgcaacaatatttgtatcggttgggtcaaaatattttaccgcttgcggctccgccaacgattaattttcgggattttgtggctctagagcaaaccattttaaaatcccaaccctgtcaagaatattggcaaaagcaattagaagacctgactattactcccttacctgaatggccagaggttagtcaaaaaaacaaaaattgggattggttagtgccgattccaacggaggtttcccagagcttaaaacggttaggaaaaaaagcgggggttcctctcaaaagtgttttattagcggctcatttgcgggtcttaagcttactcaataatcaaacagatgtactgacaggtttagtgtctaatggccgattggaagaaactgatggggaaagggttttagggctttttctcaatactttgcctctgcggttacagctaacgggtggaacctggttagacttagtacgacaagtttttgcaacggaacgggatagtctggcctggcgacgttatcccttagcggagttacaaaaaagattgggtggtcaaccgttatttgatacggcttttaattttgttcattttcacatttaccaagccattatcggggtgcaggacttggaagtgttagggggtaagttttttaatcaaaccaatttcactctgctgacgaattttagtctgcatccgctatcgggggaggtggagttaacgctcaagtatgacggcgatcgcctgggacaagcacaaatggagcgaatggcggggtactaccaaaaagtgctaaccgcgatcgcccaaaacccttcccaatcctttcaagacctttgtttattgtccgacgaagaacaagcacaaattttgtgggactggaatcgtactcaaaccgacttaccgccccaacaatgcgttcatcaattatttgaaatccaagttgaacgcagtcccgatgctgtcgctattgtttggaatcaggaacgcttaacctatcgccagttaaatgaacaggccaatcaagtcgcccactatctgcaaaacctgggagtggaatcggaaagtttagtgggaatttgtctggagcggtctttatctctggtggtgggacttctaggcattttaaaagcaggaggagcctatgttcccctcgatccccactatccgacggaacgactagaactgattttgacagactcccaagttcctgtgttgctgacccaacagactttactgagccacctatcccactactcaggcgatcgggtggtgttggacagagacgcggcgattattgcccaacagcctaaaaccaatcctaagagtcaagtcagttcctctaactcggtatatgtaatttatacttctggttcaactggtaaacccaagggggtcgtcattgaacatcgcagtaccgtcaccctactagattgggcgcgaaccgtgtttagctttgacgaattggcaggggttttagcctccacttcggtttgttttgacctctcggtatttgagttatttttgcccttgaccgtcgggggtgcagtgattttggccgacaatgcccttgctttacccaacctcgcggcggcgaccgaagtgaccttaattaataccgtacccacagcgatcgcccaacttttagccctagaagcgattccccagagtgtgcgaacagtcaatttagcaggggaacccttatccaactcacttgtacaaaaactttatcaactcccccagattgaacgggtttataacctctacggcccctcagaagacacttcctattccaccttcagttgcatagaaaaaggcgcgacaacccaacccagtatcggtcgtcctattgcccatagccaggtctatctgctgaacgcaactcatcagcccgttcccctgggaactatcggtgaactctatatgggaggggcgggtctagcgcggggctacctccatcgtcccgaattaacagccgaaaaattcattgccaatccgtttcattctccccttcaaaagtaccaaggtctaagtccttcgcccaagctttataaaacaggagatttggcccgttaccgtcccgatggcaatttagaatttctcggtcgcagtgattatcaaatcaaactgcgcggtttccgtatcgagttgggagaaattgaggtggttttagaaaattgccctggggtaaaacaggcggtggtattgcgacgggaagatctagtggggggggcaaaattagtggcttacgttgtcagcgaaaactccactctcacgacccaagatttacgccgtttcctagaacagcaattgcctgattatatgattcctgggttttttgtgcctttagaaagttttcccttaacccccaatggcaaagttaatcgccctgccttaccccgacctgaaatggagttaattcctgatggggattttgcggctccccaaacggcccaggagcagattttggcgaccatttggcagaacgttctaggcattcagcaagtgggtcgcggcgatcgcttttttgaattgggaggggattcgattctcagtctgcaagtcgtggcccaagcccgtcaagctggcctcaaaatcacaccgcgacagatttttcgatatcccagcctggcggaactagcagcctgttgtgacatagattctatcggggatacacctaacttctctaggactttaacccaccagggtttagtcacgggtgaagtacctttaacaccgattcaaaagtggttttttgagcaaaatcgatctgattctcaccactttaatcaatcggttttgttaaacgttcctgcccagactcaacccactttactctcccaagccctcagtcacctactccaacaccatgacgcgcttcggttacggtttaacttaaagcaaggacaatggcaacaagatcacggagaaattaccgagaccgttcccttggcagtgattgatctctcaagcattgctcctgaccaacagttccaacgcctagaggagatcgcgacggagcagcaggccagtttcaatctggcagagggaaagctaatgagggttgttctctttcaattaggcggccagcagggaaatcgcttactgatcattcatcatcatctcgtcgtagatggggtttcctggagagttttactggaagacttatggacggcttaccaacaattagaaaatcaaaaaacagttcaactaccacccaaaaccctagccttccgcgattgggctctcctattaacgacctctgcccaggagcagactttgcaaaaggaattgtcctattggctaaaccagccctggtcaaccgtaatgccgttacctctcattcatccgccagaaaaacgctcccatcccgtcgccgaggtggcagagatcacggtaacactcaatgtagaaaaaacccgcgcccttttacaacaagtcccctcggtctttaatacccaaattaacgatgtattgttaacggctctggcgcaaactttgacagcctggacgggcaattctaccatcctgctggatttagaaggtcatggacgggaagagggattggcagaagtggatgtttctcgcacggtgggttggtttaccagtctttttcccgtgattctccaactgcctgacagcaatcaccctggagaaagccttaaatccatcaaagaacagttaagaatgattcctaatcacggtattggctatggcattttgcgttatctcagccccgatgccaatgttcgcactcagatggcggcattgccaaaacgcgatattattttcaactatctcggacagtttgatgggggacaatcccaggcaaccccttggcaattagcccccgaatccaaaggagccaatcatggttcagccgacgctcccagtcattggttggaaattaatgccagggtgatagggggtcaattagagataatctggagttatgctcgtcacatccatgacaaagcaacagtggtcggattagctgagaattatctgtcggccttgttaaagttgattgattattgtttatcgcctgtagtgggcggttttaccccttctgattttcccgttgccaacttaaatcaacaggaattagacgaaattttagcagaacttgattagggaaattttatagatggtagccgaacaatctaaagcgagtcataaaaatgtcgccgctatttaccccctttctcccatgcaggaggggatgctctttcatagtctctatgcccccgactcaggcacttactgtagccaaaccctaatcacccttaacggagaacttaaccttggggcttttaaacaggcctgggaaaaggtagtagaacgacacgccgtactcagaactctctttctttgggagaaacgtcaaaaaacgctacagattgttcgtaaacaggtagatttaccctggaattattctgattggcaacctctatcgcccagggaacaacagcagcaactagacgcattgctcaaagatgaacgtcaaagggggtttgctctcaaccaagctcctttgatgcgttgccatttaatacagctatcgcaacaaagctatcattttctctggaatcgtcatcatattttgttggatggttggagcggagccattatttatggggaagttttacaaatttatcaagctctctgccaggagcaaaacccctatctttcccctgctcgtccctacgaagactatattgtttggctacaacaacaagaccagtcccttgcagaaaacttttggcggcgatcgctgaagaattttactacaccgacaaacttaggcattactcgttctattttagtagaacctcaaagtaagcccgtctatcaatccgcagatttatccctatcccctgggttaaccgagaaacttcaaaccctggcacagcaacaaaatctaaccctttccaccctaatacaagccgcctgggccatccttctcagtcgctatagtggtgaatctgaagtcctctttggcattaccgtttcgggtcgtcctgccagcttgtcgggcattgaaaaaatggtggggttatttattaataccctacccctgcgggttactgttacagaatcagagactattttgccttggttagaagaattacagcaaaaacaggcagaaattcaggactacgcctatagttccctggcagaaatccaaaggctgagtgatgttctcccagggctacctttgtttgaaagtttagttatctttgaaaattatcccagggaggagcggctgaccgactccccgcaacagctatcggtgagcggggtcatagattttgaagaaacgaattatcccctaaccgtcgcggttattcccaaacaagccttacaattccaatttagttacgatgtcagccattttacccatgaaagtataatccgcctaactggtcatttagaaaccctattaaccgcgatcgcccagaatcctcagcaatctttaggacaacttcccctattaacagcagccgaacgccatcaattattagttgaatggaatgatacggcggttgattatccccaacatcagtgtttgcatcacctagttgaagaacaagttcttaaaactccagaggcgatcgctgtcatttttgaagggcaagaattaacgtaccaagcattaaacgaacgagctaatcaattagcccattatttgcaagaaaaaggggttaaacctgaagtcttagtcggaatttattttgagcgttcccttgaggcaattattgggattctcgccatcttaaaagctgggggagcctatgttcctttagaccctacttatccccgcgatcgccttgattatatgctgacagattcagcagtttcgattttgctgacccagcaatctttagttaccaatttgagggaagatttagacaccttgaagatagaatcattctgtttagatagcgattggttgatcttagaaaattacagcagagaaaatccaagcagttctgtccaatcagaaaatttagcctatctgatctatacatcaggttccactggcaaacccaaaggggtgatgaatcttcatcagggtatttgcaataatatcctacgcactaaagacagctatcctacgacaaaccgcgatcggcttttacaaatttcttctctagcttttgacgcttcagtgttggatatattctggtcattaagcagtggcatggctctgatcattcctaaaccagaagggactaaagacctcgcttacttaatccagttaatgatagaaaaaaaagtcagtcaagtcttttttgttccttctctgctgcgacttttactacaacaacccaatctagaaaattgccgttatctcaagcgagttttttgtggaggtgaagctctttcctctgaattaatgcagcagttttttcagcattttaactgtgaactacataacctttatgggcccacagaaacctccgttgatgcgacctgctggcaatgtccaccgcgaaccgatgatcccgctattgcgattggtcgtcccattgctaatacccaaatatacattcttgatcgtcatttacaacctgttcctgttggcattgtgggcgaattacatattggcggcataccgttagcgaggggttatcttaatcagcttgagttaacggctgaaaaatttattcctaatccttttggtcaaggtaaattgtataaaacaggtgacttagtccgctatcttgccgatggcaatattgagtatctgggacggattgataatcaagttaagctacgaggattacgcattgaattaggagaaattcagacaattctagacagccatccccaaattaatcaaagtgtggtaattatacaaacagatagcgaagacaatcagcgtttagtggcttatgttgatagtcaaaatcaagcattaacacctaaagaattgcgacagtttctccagccaaaattacccgcctatatgattccgtcggctttcgtaattttgccagagtttcctttaaatgccaatggcaaagttgatctgaaaaaattaccccagcccaatgaaacagctttggtagaatctgtctatgttgctcctcgtaatccaactgaaacaattttagtcaatatctggcaagaagttttatccttagccaaaataggcattaatgataacttttttgaattggggggtcacagtctgaaagccattaccttagtgagtaaaattcaggaaaaaatgggcattgcctttgctattaaacaagtcttttcccaccccacgatcgcagaacaagccggtttattaacggaaacaaaaaacgaggaaaatttggcaatattgcccattcctcacattcctgaccaggtaaaagttgccacatcccacgcccaaaaacggttctttgttttacaacaaatggacttaaataatgtagcctatcatattacctctatcctaaaattaacaggagaatttgccccagataagtttaaacaagcgatgcaattattgatagatcgccatgaatccctacgaaccgcttttgtcttgactgatggggaacctcagcaaaaagttttgctccatcgtcctttttctttggtatttgaagattggacagaggaatttaatgccgaaagtcgtatcttagagattcttcaagagcaaagaaaaccctttgacttagaaaaagaccctttattacgatcttctctttatcaattatcacctcagagctatattttatttctggaaattcatcatattatttgtgatggctggtcaatgaatttattggctaaggaatgtttaggatattaccaagctcttagacaggaattagagccaaccgtagagccattacccattcaatatagggactatgcggcttggcaaaataaccagttaaaacaaaaagatcaaaacaaaaatttagattattggcgacaaaaattagataacggacaaattccccgcgttcatttaccgacggattttttgcgatcgccccttaaaagttataacggttcccatctgagttggatattgccaacagagattaatctgcaactacgcaaagtttgtcaagacagtaaaagcactttgtttatggctctagttgccgccgtcaaagtcctgctttatcgctatagtggtcagcaagatattagtattggtacagaaattgctactcgcaatcatcctcagttacaagaattaattggcttatttttgaatactttaatcctccgcgatcgccttgatccagaccaaagttatcaggattgtctgagtaagatacgtcaaactgtcagcgaggctctagcccacagtgactatccctttgatcggttattagaagacctgaatatctcgcgtgaaatcaaccgaactcccctctttgatgttctagttttattacaaaactttgatcaaactccaaccatagaaactctcaatattcaatctttagattccctcactcccaccagcaaatttgatttatcctttgtttttagtgaaaatcaagaaaatatcagattagatttaatttataataccgaccttttccaaaaagaacgaatggaaaaatgtctgcttcattttgataaattgttgacagcaatgttagccaatccagagcaacccatcggcaaaatttctcttctttcggattcagaaaccgctttgatagaagactttattcgtcctatccctcgccttgaaattcgtactgttcttgatgattttgccgatcaagtccgaatccagagtcatctccctgctcttgtttatacagaagacggattaactaaacaattaagctatcaagaattggatcaattaacagatatttgggcaaataacttaaacaatttaggcattgagaaagagagcatttgtggcgttagtttagaaggagattaccgtcaggtaatagcaatgttggcggtatttaaagcgagaggaatttatttacccctgcgtttagatgaaccagaagaacgttggcaacgcatgattgttaaaacctcccccgctataatcttgatagccgcagaaaatttagagatgattaaacctcgattattagtattagcaaaaccgcctaatttattggttgttaatcatcaagaaattcagcaatattacgaatggaatggcacaaattatcaagagttttctatcgtagaaaataataatagaaaagatttattaatgcctgatgctgatgatgctaactatattatatttacttccggttcaacgggtgaacctaaagccatcttaggaagtcatggtagcttacgtcacttcataaattgggaaaaaattgaatttggaattaatcataactggcgttgtttgcagatagctcaaattaactttgatccttatctgagggaaactttggttactttatgttcaggaggaactctttatattcctgatagtatagaccgcgaagatttggagcgtttgctactacgtttaggagaatggcagattaacttactgcataccgtaccatcggtaatgcgtctatttttaaatattggtcgtaatttacctaatgccaatcaattactcaaaaatttacaggtattagtgttaggaggagaaccattatttgtcaaagaattgtgtgaatggcatgaagtttttggcaatcagacagaatttgttaatatttatggagccagtgaaacaacttttattaaacattttcatcgaataccaaaacctaataatatttcctatgcgcgagtacctgggggaaaaacattgcccgatgctgcattcgcagttattgacgaaaatcgtccatgtgccataggagaagttggagaaatttttgttaaatcgccttatttaaccaaaggttattatcaagatgaaatcttaacaaattcagtttttgttcccaatcctttgaataatgggaatgatttagtttatcgtaccggagacttgggacgattgctccccgacctaactttagaggtaataggacgacgtagtgataaccaaataaaattgaatggggtaaggattgagttaggagaaattgaagatgccgttgccgccattgatggtgtccaaaaagcactggtaatcgcggataaaaaagaagaattagtaacagtaattgcctattatcaaggcaataatactgtaaatcgtgaacaaatcagccaaaaactaaaacaagtgttaccgacttatatgcagccaacttttttaattcaattagaatcttttccgttgttacctaatggcaaaattcatcgcctagccttaccaaaacccgaaggaaatattacccaatcaattagtcaaccaactgggtttaatcaacaagaggctttattagccttggtttggggtgaattattagaaatagaagtaagtgacaataatcagtcattttttgaactcggaggcaatagtttaaaagccatgcgattagtgtcccaaatccgtaatcagtttggggtttcactacgattacgcgaaattttcactcataatatattaaaagaacaagcaattttaattcaatcacgacaaacaaaatgagcaatttatcagacactattaactaatttttttaataaaaagcaaattttaacaattcaatcagaacaaacaaaatgagcaacttacaacaatctaactcgattgcccccctagcaaagcaacaatattatgacgtatcccacggccagcgacggctgtggattttgcaccatatcaatgaatattccagtgcctataatattagactagctatcagaatacagggcaacttaaatgttacgatattgacaaaatcttttcaagaaattgttaatcgccacgaaattttgcggactacttttgccagtatagctggaaatattcagcaaattgtccatgaaaatattgctaaggaacaattagtcatttttagggatttaagaggacaaaaagatgctgaaatcctagctgatactttgattcaggaatcagctaattcacggtttgatttagataaattaccgctaatgcgagttttattagtccagattaaatcggaggaatttctgtttggtttaacaatacatcatattattggtgatgcgacatcacttgatattatatttaaagagttcgtgactttatactttgctgatattcaacaaaaaaatgccttattacctccgctagaattacagtataaagattacaccgcatggcaaaatcagtggttagaaagtgaagaagttagagaacaacataattattggtgcgatgtttttgcggaacatccccccatcctgaacttacccaccgacttccctagacctcaattaaaatcttctcaagcagcttcatatacttataattttagtcagagtttgagtgaacaattacgcagttttgcagctaaaaatcagacaactctatttattaccttgctaaccttatttaaaatattactctaccgttacacaggacagcgtgatttagttattggtatccctatttctggaagaaatcatccagatttagaaaaccaaataggattttatgttaataccttagctttaagaactttactcccagaatcgggaacttttaaacaagtattgacggaagtaactaatacctgcattgatgcttatgaatatagtgattatccttttgataaattagtatccgctctcaatttagaacgggatttattacgaaatccgttgtttgatgtcatgttttcactgctgagtaaagaaagcaaaacagtgatggaaattcctgaaattgaacatcaagaatatcccctaaaaccacgaactgcccaatttgatttgacttggagtttctttgaagatggcaataatctcagattagccatagaatacgaacccgatttatttcgacctgaaacaatcgctagaatgggcggtcactttttacaaatcattcaaacagtaattgaaaatcctaatattcaattatcacaaattaatttactaactcctgaagaacgtgatcaattactaatagattggaacaatactcaggctgaatatcctcaagataaatgtttgcatcaactatttgaagaacaagtaaaacttaaccccaacgccatagcagtaatctttgaagatcaaaaattgacctaccaacagttaaataagcaggcgaaccaattagcccattatctacaagaaaaaggggtaaataaagaagtattggtgggaatttttattgaacgttctctggaaatgatcatcggaatattgggaattttaaaagctgggggagcttatatacctttggatcctaattatccagcagaacgtttaacttatatgatatctgattcgcgctgttccatcttattaacccagcagtctttagtacaatttttaccaccaaatcaagccgagttactatgtttagatagggattggcaaagcatagcaaactatagccaagaaaatccaatcaatgcagtaacctcggacaatttagcttatgttatttatacttctggttcgaccggaaaacccaagggcgtgatgaatcttcatcgaggtatttgtaataatttatggcgactgattgatgcttacccactcacactagaagatcgcatcctacaattaactccttttagttttgatccttcagtctgggaaatattttggtctttaatatctggtactaccctagtagtggctaaacctgaaggtcataaagatatagcttacttaattaatttgattgccagcgaacaagttaccaacatcggttttgtcccctcaatgttgcgagtttttttacaacaaccaaacttagaaagttgtcgttgtttaaagcgaatattttgtggtggagaagccctatcttatgaactaaatcaactattttttgaaagattaaactgtgaattacataatctttatgggccaacagaaacagcagttgatgctacttactttcagtgtaaacctcagtctaattatcaaataattcccattggtcgccccattgccaatacccaaatttatatcctcgatcaatatttacaaccagttcctattggcgttgctggagaactacatattgggggtgtgcctttagctagaggttatctcaatcaacccgaattaactgccaaaaatttcatttctaacccttttggtaatggtaaattgtataaaactggagatttagctcgttatctacccgatgggaatattgaatatcttggtcggattgataatcaagtcaagcttagaggtttacggattgaattaggagaaattgaatctcttttagctactcatccccaagtagagcaaacagttgttattctaccaaaagatattactgaaaaccaaagtttagtcgcttatatagtcggaaaaaacctatcagtaaatcctagggaactgcggagttttttacaggctaaattgccagtttatatgatcccttccgcttttgtaattttatcggaatttcccttaaatcccagtggtaaaatagatattaaaaaattaccaaaacccgatcaaagatcaatagttgaatccccgtatttagccccaggtaatcaaaccgaagtcatattagtaaatatttggcaacaacttctacggatatctaagataggagtaaatgataacttctttgatttgggtggtcattccttacaagcgatgaatctcatggcactcatttatcaagagacagagatagaaattcctttatcaatcatttatgaaaaaccaacggtgaaggaattgagcgaatatattatctatgccaaagaaatgaatattcaaccaaaagaacgtccttatgttgtgtttaataaacagcaaaaaaaggcagtatttttatttcctcctgcccttggttttgccacagcttatacaaatttggctgattatttaacggattatactatctatacttttagatatatcgccgatgaattaatgttagaacaatatgcagaattaatcgatcatttatctcctgatcaagacctaaaattaatggggcattccgccggaggttttttagcaatgttaattgccaaaaagttagaaagccgtgaccgagtagtttctgatattattttactagatacttaccgaggcggtagtgagacaaaaaaagctgatatgtcagaaataaaagccggggttgatggtttcttattaaatcccaaacgtcaggaattaagacgttactttttagaaaatcaaaaattacgcgatcgcacttataatcaagtttgggaatactttaattttctctggaattccgacctaaaaaatctgcaaattaatgggactattcatctgattcgggctgagggtaactatgatgttgaagatgattggatacaagcgacaaaagggcaacgaattaattattacgcctctggtgttcatcgtgagatgatcgatcctccctatctgcaaaaaaatgccactattattaatagtattcttaatatgggtttggagggactaaaaaattaactttccagacacctgtatatctaatatatcattgtgttgattacggattctattgctgttaaaataaaagaactaaagtaaaggagaatattgatttggaaaatatcggcaaaattcccttaaaagatgaatggcgtaatcgctggatcatcatcaaagaatttattcagcatccaattaaggaaatctcttttttacaagacaaatttctggtatctgaactttatactaatatagccaaacgagatcccgatcttcatgatcccaatattccccaatggctaaattttggctattggaaagaagaaactacttataatggtgcttgcaccgctttagctcgtaaattaggagaaatagcagaacttcaagctggagatcaagttttagacgtcggatttggttttgctgaacaagatttactttgggtgcgggaaaatcaggttgattcaattattggactaaatacaacggagctacaagtagaaattgctcaagaaagagttgctaaaatgggattagctgatagaataaatcttcaggtaggctcggctacaaaaatccctttttctgataactcttttgataaagttacggccttagaatgtgcttttcattttgatactcgtgaggatttttttgccgaagcatttcgagttttgcgccctggtggaaagctggctttagcagattgtttgcctagagagggacgagaaattaacttttggctaaaggttaatagtaataaaatgtgcattccttttgttaatcaatatgatcggcatacttatgtagaaaaaatgaaaaaacatggatttgttaatatccaagctatcccgattagcgaatatgtttggccagcaatggttcattattttgcccaagttagtcagggaattagcaaacatgatttagttattgatctgcaaaaagataacccaggaattgaagtttggtcgagaaatagggggtggtttatggcatttgacgattatcttttattctctggagaaaaaccccattaattagattaaattagctatgaccaatcactatcccagcaaaccaaaaaaacagacaaattcccctgagattactaagtacctaaacaaaattaattacacatcctccaccctgttccctcccccccaagcccccgtgcacggggggtttggggggctgttccctctctcaactaggtaatttattttgtgtaactacttattgattaccccctttgtatgacaaattgtgggcgcactatagcagtcctaaatcattatcaagagcatgatataatgatatacactacttgattatgacaataaaaattatgaatgacttacaacaggcagaaaaagagcggaacaaagaaatagctgaattagaaattttaattgagagtaatctttcggcaagagaactaaaacgagcaatagctgtcaggatggcactcaccggtaaaatttaccgtgaaatcagccaaattttaggtgtaagcgaattttttgttgggcattggaaaaaagtttttaaagtcaaaggaatcgctggattaaaactaggatataaaggctcaaaagggtatttgagtattcaagaaaaaacagcagtaattgagtggttaaagaataaaaagtattgggatttagatgaattagttacttatgtggatcaagaatttggggtaatatataaatcgaaacaaagctactataaactttttgaccaggcaaatattagttggaagaagtctcaaaaggtgaatccaaaatttaacgaagagcaagtaaaaaaaaagagagaagaaattaatgagatgttatcaaaacaaaaggctggcatagaatcgggggaagtaatagtattttttttagatgaatgtcatctacttcatggagatgttaatggctacgtttggggtcaatcaaatctaagaattgaagttccaattaccaatgaaaaagagcgacaaacttattttggagcactgaattatcaaagcaaaagattccatgttaaaagttacccatctggggatggaaaatcaacaattgaatttataaaatacttacaaaaccaatataaaaacaagagaattatcttaatttgggatggagcgagctatcatagatttggagaatttagagaatttttatcagaaataaatggtgataaagaacctgatgattttttaattacttgtattttatttgctcctaatgctccgcaacaaaatccggttgaagatatttggttacaagcgaaaaactttttgaggaagtattggtatttatgcaggtcgtttaagattatcaaatttttgttcgagttttttactaaggaacataaatttgattttcccaaaattcatcagtatacttatatatagaaaatcatttaggattgctataggtaataggtaattatgaattacgaatattgacaattgagcatgaataacagataataaatagtaaataattaagaatattactatgcttgctaagttgactactgaaaatcagcttactctacctaaaagtataactcaagccatcggggaggccgaatattttgaagttaaggtagaaggtggacaaattattttgactccggtaaaaattcagggggctgatgctgtacgggctaaattagcaactttgaatctgaatcaacaggatattaatgatgctgtcgagtgggcgcgttagtgatgattgagtgtccacgagtagtaattgatacaaatttagttttgtcagccttagtatttgggggcaaattatccagattgcgccttgcttggcaggataatcgctttattcctttaacatctcaagttacgattgcagagttagttagggtgctgacttacccaaagtttaaactcacaaactcggagcaggaagatttgctgtcagactatttgccgttttgtgacactgtgttgatccactagtgtcgacctgcag

SEQ ID NO: 79 - DNA, 8364 bp, Microcystis aeruginosa
atggaagcacatctggtttcaattgattaccaaattcggcaacttcaagaaatagatccagtaactactctatttggtaatgtaagtcagaataaaaccggggagcaagatagcgttattgaagttatctctacagatttacaggaaaaaatcaacagtttaactgcaaataattccgttaataaattagcatttcatctggctgttgtccaggttttaatgtttaaatatactgctcaagtcgagtttgccacggctacagcagctttgaatacagaaaaattagatagcctgatattttgccgattcaatcaacagaattttagttcatttaaagatttactaagaatcattcgtaaagatttacaagaaggatatcgccatcaaaactatacgctggatagtttggtcaaaaccttggcagcaagaggaggaaatctagagaatatttttgacgttgctgtgatcaaagaagggctgtgcgccgacatttcttccttaaatcggtttcaattagtttttgccatagcagcggatgatagtggtgtttctgtcacttttattcaagataaatttcccagagattttgtcgagagaatgctaggacattaccagaaaatcttagaaacagtgacgagtaatcccgatatagatttgtcagaaattgatatattaacgacaaaagaacgagaacaattgctgagagattggaatgatacggccattcaatatcctgaaaagcaatggattcatcagctatttgaagagcaagccaaactttaccctgagagagtggcggtcatttttgaaaatcaagaattaacttatcaaaaattaaatgaaaaagccaatcaacttggtcattacctacaaaaattaggagtaaaaccagaggaattagtaggaatttatctagagcgttccttagaaatggtagtaggattattggctgttttgaaggccggaggagcttacgtccccttagatcctaattatcctcaagaacgcctaagttatctattagaagatactggggtaaaagtgatcattactgcggaatcgctgcggggattgttgggggaataccggggaattgttgttgctttggatacagattggccagcaatttctcaagaaagtcagaacaattgtgacagtggcgtaacgggggaaaatttagcctatgttatttatacttcgggatccacaggtaagcctaaaggcgtaatgaataatcataaggggattaggaatcgtttgttgtggatgcaggatacttatcagttaactaagagtgatggcattttacaaaaaaccccttttagttttgatgtttcagtctgggaattcttttggcccttattagccggtgcaaccctagtggtcgctaaaccagaaggtcataaagatagtacctatttaatacaattgatccaaaagcagcaaatcactacccttcattttgtcccctcaatgttgcgagtgtttctgcaagaaccagagctaaaagaatgtagttctctcaagcgggttttctgtagtggggaagctttgtcattagacttaacacaacgcttttttgagcattttgactgtgaacttcacaacctctacggtccgactgaggcggcgattgatgtgacttactggccctgtttgccggagaatcaaaaagctctagtgagtattggtcaaccaattgccaatactcagatttatattcttaatccgcacttacaaccagttcctatagggattgtgggagaattacacattggtggcataggtttagctcgtggatacctcaatcgtcccgaattgacggccgagaaatttatccctaatccttttgctaaggtcgaaggagaaatagggggagaaattagggcaaaattatataaaacgggagatttagcccggtatttacccgatggaaatattgagtttttagggcggattgaccatcaagttaagattcgaggtttccggattgagttgggggaaattgaagctatactcagtcaacatccagcagttgagcaagcggtagttattgcatcggagacagaaacagggagtcaaacactaattgcttatgttgtgggtcagtctcaagagggggaactcttggcgacttcagaaaaagggcaattattcgatgagcaaatcgagcaatggcaaagcctctataaccaaatttacagccaaacatcggcagattctcaagggatatttaatattgttggctggaatagtagttacacgggggaacctatcccggttgctcagatgcgagaatggctagatgataaagttaaggttattctcgctcaacaacctaaaaaagttctggaaataggttgtggaaccgggttaatattattccaagttgctccccattgccagtgttattggggaaccgatatttcatcagtagccttagacgatattcagcgaattaatcaagaagggcctcagctagagcaagtcaggctattgcatagcacagccgataattttgagggtttggagtcagaaagattcgatacaattatccttaactcggttgtgcagtatttcccccatatagattacttattgcgggttttagagggagctatcaaggtactaactccgggggggtgtattttccttggagatgtgcgaaacttgcaactcatggaagcttttcacgctgatgtagaactttataaggctaaccctgaggatgcgattaaggattttaaacagcgtgtacagagaaaaattgagcaagaaaatgagttattcattgacccggatttttttagagcaattcagtcctattttcctcagattactgaagtcgagattcatctagagagaggtcaacaccacaacgaattaactcaattccgttataatgttgttctgcggattgaaacgattctggattttagcaccgactttccagaatcaaactggactgaacagcagctgactttatctgaggtaagaaatcaactggggaaatctgaggggttaagggtgataggtgtccctaattctcgcttgttcggacctttaaaaagtgcggaattgttgaggaattctcaagactttgggacgaccgaggaatttaaagctattaaatcggaaattatcccagaaaatgccgtagaacctgaagatttttcggctttagctgaggatttatccctttcggtttgggtaacttggtcggatactccagaccgttacgatgtgatttttgccccgctggaaaattcccgtagaaattacatcgcttttacccccacccacaccgcaaaacctgaatggcaactttatgcaaatcaccctttaaggtctaagttaaacagtaaactgattccccaactgcggagttatctgcaaaaccaactcccagaatacatgatacctcatgcctttgtgcaattggatgctattcctctgacaaatagtggaaaaattgaccgtcgcgccctaccctctccaagctataacagtttaaggaattcggagaattttgtagcaccttgtacccctcttgaggaaattttagcactgatttgggctgaagttttgggcatcgaagaggttggtattcacgataatttttttgaacttgggggggattcgattcggggcatacaagtgatcgctaaggcgcgacaaatgggttttcatttttctttaccccaattattgcaacatcaaaccattcaagaattggccaattgcgttagctatgaaattgatactttagggactgaaaaaacggaagtttttagtttaatttctcaagaagttcgcctcaatttactggaggaagtggaggatgcttatcctctaactgctctacaattggggatgatatttcatagtgaatatcaggggaatctatcggtgtaccatgatgtgtttacctatcatattcgtgctgattttagttttcccgctttacatagtgctattcaggagattgtccagcggcatccagtattacgaaccagtttcgcactctttgaatatcaggaacccctacaattagttcatcgacaaatcgatgttcctttaggattagatgacctaacccatttatctacttctgaacaagacacggctattgatgattggattgagcgggaaaaaatccgcacttttgactgggatagtcctcctttatttcgctttcatctccatcgccgcagtcaggataactttaacctaactttcagttttcatcactctattttagatggttggagtgtggcttcgttgctcacagaattgttacaacagtatctctatcttctcgacaaaaaagttctccctctctctccaactcctgctcttagttttagggattttgtcgccttagaaaagaaaactgtccaatcgccagaatgccagaattattggcaagaaaaactcagagatgtgacgctgactaaacttcctcagtggtcgaaatctaatcaagttaatcaagattgggattggttagttcctatatctagtcaggtatctcagggattaaaacaactcggtaaacaagtgggagtccccctaaaaagtgttttattggcggctcattttcgggtattaagtttactgaataatcagagggatattgttacgggtttagtctctaatggacggttagaagcagccgatggggaaaagatattaggtttatttttgaatactttgcccctacgtttagagttatctggaggaccttggagcgatttagttaagcaagcttttgatgttgaaagagaatgcttatcttggcgaagatatcccctcgctgagttacaaaaatcaggtcaacctttgtttgatacggcttttaattttattcatttccatgtttatcaaggtatcatcggggtgaaagatttagaagtcttaggagggaagttttttaatcaaactaattttacattgttagctaattttagtcttcatcccctttcatctcaaatagaacttacccttaaatatgatgggaattatctaggggaaaagcagatggagttaatcggaggatactacgagaaaactctcatcgctatggcaacggaagggttagaacgttatgaaacttgttgtttactttctgagcaagaacaacatcaattattaaaagaatggaatgataccgaggttcactatcccgatggctgtattcatcaattgtttgaggagcaagttaagcgcagtcctgatgcgatcgctattattacagaaaatgaacaattaacctaccgtcaattaaacgaaaaagcgaatcaattagggcattatttaggcaaaaaaggggtaaaaacggagtctttggtgggaatttgcctagaacggacccctgagatggttatagggttattagccattctcaaagcagggggagcttatgtacctttagatccagcttatccaactgaacgcctcaatgttatcttagaagatgctcaagtttccttgttgctaacacaagcaaaattagtagagaaattagggaattatccagggaatctggtgatattagaggcagaagccagaaatatagccctagaaagtcccgaaaacctctctttacccgtaagttccagtaataccgcttatgtgatttatacctccggttcaacggggaaaccaaaaggggttgtcattgagcatcacagcaccacaaccttactgaattggtccaaggaagtctttagcagtgaggaattagcgggggttttgggagctacttctatttgttttgatttgtcagtatttgaactatttttgcccttggctgtggggggtaagattattctggcccagaatgttctagatttgcctagtttaagtgcagccaaagaggtaacattaattaataccgtacctacagcgatcgctcaactgctggaaattgaggcgatacctgagactgtgcaaacggtaaacctcgccggagaagctttgtctaatcaattggtacagaagctttaccagcaggaaaacattaagaatgtttataatctctacggtccttcagaagataccacttattccacttttagcttagtgcctaaaggacaccatggacaaccgagtatcggccggcctattgccaatactcaagtttatattctggactcttttaagcaaccggttcctctaggaactattggtgatttatatatcgggggtaaagggttagctcgatgttatctgaatcaacctgaattaaccgccgagaaatttatctccaatccgtttagtaatgaacccaatgccaaactctataaaacaggagatttagcccgatatttacccgatggaaatattgattttttggggcggggtgataatcaggtaaaattgcggggtttccgcattgaattaggagaaattgaggcaactctagggacttatccccaagttaagcaaaaggtggtgaaggtttgggaagactcctatcggaataagagattagtcgcttatctagtaggagaaaatggtccgataaatactgaggatttgcgtcgtttcttgggacagaaattgccagagtatatgattccggctctttttgtctccttagaagctctccctctgactcccaatggaaaaattgaccgttccagtttacccctccctgagataccttggacatctgagcaggattttgtccccccgcatactcagaaagaaaagattttggccagtatttggcaagatgttctcagcattaaacaagtgagtcgttatgaccgcttttttgaagttgggggcgattctattctcagtattcaggttgtcgctcgcgctcgtcaagccgggttgaagattacccctaaacagatatttgaatatcctactcttgctgaactagctacagttgccgattattccacagccgaattagctaaacagggtttagtgaggggtattgtgcctctcactcccattcaactgtggttttttgagcaaaatcgcgctgaaatgcaccactttaatcagtctgtcctcttagaagttccccatcacctgaaagctgatttgttagctcaatctctgagaaaattaattgaacatcatgacgctttgcggttacggtttactgtggaggaaggacaatggcaacaagttaatgaaggaatgccggaggaagtaccttttgaagtgattgatttgtcttctattcctcaatctcagcaaagggaaactctcttagcaatggcaacaactcaacaggcaagtttaaacctctctactggactattaatcaaggcggtactatttgaattggcgccctatcaacccagtcggttactgattattattcatcacttgggggttgatggtgtatcttggcgaattttgttagaagatttattgatgacttatcaacagctagaaaggggggagaatgtagaacttccacctaaaaccatagcctttcaggattgggcgcttctcttgagggattatggacaaggggagaaagcgagagagccattagactattggttaactcaaccttggttagaggcgagaaatttacctgtagatgacgaggctggaaaacaatacaatacagtagcgacggcaaatgatgtcacggtgactctagatgaagaacaaacccgcaccctcttgcaaaaagtccccgctgcctataacactcaaattaatgaggttttgttaaccgctttagcagaaactttgacagaatggacagaaaatttgaccatatctcttgatttagaaggacacggacgagaagatttgttcagtgaggttgacttatcgaggacggtaggttggtttaccagtctttttccggttattttgcgactcccccccgaaaatcaccccggtgagcggctcaaatctattaaagaacagttacgagctattcctcacaggggaattggctatggaatttcgcgatatttgagtgatgatgctgatattaagtctcaattagctgaaattcctgccagagaagttttgtttaattatttaggtcaatttgagcaaggacaattgcaaaaaggggattggaaattagcgaatgagtctaaggggcctaatcacagtcttaagggacatcgtagtcatttattagagattacggccagagttatcgagggacagttacaagtaaactggacttatagcgatctcatctatgaacgttcgacggtagaatatttagggcgcagctataaagaagctttgctgaaattgattgagcattgtttatctcctgatgctgggggttacactccctcagattttccagtagcacacttgaatcaacaggaattagacgatattctggcagaaattgactaa

SEQ ID NO: 80 - DNA, 8364 bp, Microcystis aeruginosa; identical to SEQ ID NO: 79

SEQ ID NO: 81 - DNA, 63626 bp, Microcystis aeruginosa; identical to SEQ ID NO: 71

SEQ ID NO: 82 - DNA, 6381 bp, Microcystis aeruginosa
atggcagacacaaaaaatcaacccgccaaaaatgtggagtctatttatcctctttcccccatgcaggaagggatgctctttcatagtctttatactcctgattcagggatttattgtagtcaaactctaattactctggagggagaaattaaccttgcagtttttaggcaagcgtgggaaaaggttgtagagcgtcactcggtattaaggactctatttctttgggaaaaacgggaaaaacctctgcaaattgtgcgaaaaaaggttgatttgccttgggattatcaagattggcgcaatctttcccccacagaacaacaacaacgtttagatttattgttagaaacagagcgtcaacaagggtttgaactaaaagttgctcctttaatgcgctgcttgatgattcaactatcggaccaaacttataaattcctctgcaatcatcatcatattattctggatggttggagtatgcctattatttatcaagaagttttagggttttatgaggcaggtattcaagggaaaagttatcatcttccttcaccgcgtccttatcaagattatattgtttggttacagcagcaaaacccatctattgctgagagtttttggcagcgaactcttgaagggtttatgactcccacccccctgagggtggacagactccagttaatgaaatctgaaggtaagccgacttataaagagtataactgtcatttatcggcttctcactccaaagacctgcaatctttggcgcaaaagcataatctgaccttatctactctagtacaggccgcttgggcgattcttctcagtcgctatagtggggagtcagaagttttatttggggttacggtttctggtcgccctcatgatttatcaggggtagaacatagggtaggattatttattaatacattgccgctgcgagtctccatcagagaatcagatttattgctatcttggttacaggaattacagcaaaagcaagcagaaattcaggattatgcttatgtttctctggctgaaatacagagattaagtgatattccaccgggggttcccctgtttgagagtttggtcgtttttgagaattatcctagagaagcgttatcgagagattctcgtcaatccttaagggttaaggatgtggagaattttgaggaaactaattatcctttgacggtggttgctattcctaaacaggagttactgattcagttagtctatgatactagccgttttactcaggatacgattgaacggatggcagcacatttacagactattttaacagggattgttactgatactcggcaacgggtaacacaattacctatattgacaacacaagagcaacatcagttattagtagagtggaacaataccgaggcagattatcctttagataagtctttacatcaattatttgaggaacaagttgcacagaatccgcagggaatagcggttatttttgaagaccaaaaattaacctatcaacagttaaataaccggggcaatcagttagctcactgtttacgagataagggtgtaggtccagaaagtttggtcgggatttttatggagcgttccctagagatggtcatcggtttattagggatattaaaagccgggggagcttatgtacctttagctccggattatcctaccgagcgcttgggggatatcctctcagattcgggggtttctttggtgttaactcaggaatctttaggagattttcttccccaaactgaggccgagttactgtgtttagatagggattgggaaaagatagctacctatagtccagaaaatcccttcaatctaacgactcctgagaatttagcctatgttatttatacatcaggttcaacgggaaaacccaaaggcgtgatgaatattcatagaggaatttgtaatactctgaaatatactattggtcattataatattacctctgaagaccgcattctccaaattatttccttgagttttgatggttcagtctgggaaattttttcgtctttaatatctggtgcttctctagtcgtggctaaacctgacgggtataaagatatagattatttaatagatttaattgtgcaagaacaagtaacttatttcacttgtgttccctcaatattgcgagtttttctgcaacatcccaagagcaaatattgccactatttaaaacgagtaattgtcgggggagaagccttatcttatgaactcaatcaacgattttttcagcagttaaactgtgaattatataacgcttatggaccaacagaagtagcggttgagactactatctggtgctgtcagccaaattcccaaatttctattggaactcccattgctaatgcccaagtttatatcctcgacagttatctccaaccggttcctattggtgttgctggagaattacatattggtggaatgggtttagcgcgtggatatctcaatcgtctggaattaactcaagaaaaatttatttctaacccttttgctgaggggaaattatataaaaccggagatttagctcgctatcttcctgagggcaatattgaatatttaggacggattgataatcaagttaagctgagaggtttacgcattgaattaggagaaattcagacggttttagaaactcatcccaacgttgaacaaactgttgtgattatgcgggaagataccttatataatcaacggttagttgcttatgtaatcagaaaaaattctttattaactcctcaggagctacgccgtttcttacagcagcaactgcccgcttatatggtgccttctgcctttgtcatgttgtcggattttcccttaaataacaatggcaagatagacaggaaaaaattacctatccccgatgagacatcaattattgaatctgcttatatagccccaagaaatgaaaaagaaagcctcttagctcagatttggcaagatgttcttcaggtatccaaaataggggttagtgacaacttctttgagttaggaggacatagcttaaaagctatttctctagtgagtaaaattcaggaaaagttagggcaatctttgcccattaaacaagtatttgctcatcctaccattgctgaacaagcagcattattaagcactgttacccctctgacggtagccactattccccttgtatctgcacaagaaacctacgaaacatcccatgctcagagacgtttctatgtcttgcaacagatggatctcaataatgtagcttatcatattgtttccaccctcaaaatagcaggagattttagtccagatgtctttgaaaaagccatacaattattgatttcccgtcatgaatccctgcggacatctttcattttaattaacggtgaaccacaacagaaaatcctgcaaaatcgtccttttgattgggaatttaaagactggacaaataaacctgatgaagaaatcctagaaacgattgcaaaagagagaaaaccgtttgacttagagaaaagtcccctggtgcgctctaagatttataaactatctccgaatgaatatattttagagttagaaattcatcatattatctgtgatggttggtcaatgagtttgttagctaaagaatgcttacaatactactctgatttagccaaaggattacagcctagtatagagccattgccgatacaatataaagattatgcaggatggcaaaataatcttttaagaagcgaaaataattcaaaaaacctagattactggcggcaaaaactggacaatggacaactgaccagagttcacttaccgacagactttaaacgtccccaaataaagacgtttaagggttctcatttaagctggacatttgaccgagaaacgatttctaaattaagaaaaatttgtcaggaaaacgaaatcaccctattcatggcattggtagcggctgtcaaaatattactgtatcgctacagtggtcaacatgatattactattggtacagaaatcgccaccagaagccatcctcaactgcaatctctaatcggtttatttctcaataccttagttattcgtgaccaaattgaacccgaaaaaggctacaaaaatctactcgcaaaggttcgtcaaaccgttaccgaagccttagaacattccgattatccctttgatattttagtagaaaaattagctgtttctagagaaattaaccgcactcccttgtttgatatattagtccttctgcaaaattttgatcaacctgtaggcttggaaaatatacaaataaaatctctagattccctgaccccgaccagtaagtttgatctatcttttgtgtttagtgaagatcaggaaaaactcagattagagctaatttataacaccgacttattccaagaggagaggatgaaaaaatgtctcattcacttcgataaactcttgaatgaaatgctatctaaccccgcccaacccgtcaaagacatttctttgttatcggaggcagaaaccgctttcattgccaattttatcaatcctattcctcgcttagaaacccgtactattatccacgattttattgaccaagttgcagccaaaccggagaaaacatcgattatttatccagggggtaaatttagctatcaagaattacatgaactaactaacttttgggcttatgccttaaaagaattaggcgtggaaaaagataaggtttgtggtgttctcctagaaggagattatcgtcagttaatcgccatgctggcagtatttaaagccggaggaatctatttacctctacgtttagatgaaccagaggagcgccggcaacgcatgatgattaaaactagccccgaaattatcttagttgcggctgagaatttagaggggattaaaccccaactatccgcattagaaaaaccgcctcatatcttagtggttaaggctcataaaattcagcaatatcatcagtggaatggcatggattatcaagagtttccttgccaattaagcaacctgaaacccgttctagctatgccagatgctgatgattctaattatattatgtttacttctggctccaccggtgaacctaaagcaatcttaggcagtcacggcagcttacgtcatttcattgattgggaaaaacgggaatttggcattaatgaaagttggcgctgtttacaaattgctcaaattaattttgatgcttatttgagggaaacctgtgtgactttatgctcagggggaactctgtatattccagagagtacagagcgagaagacttagagcttttattactgcgaataggagaatggaaaattaacttactacacactgtcccctcggtaatgcgtctatttttaaagatggggcgtggtttaattaatgcacataatctcctgaaaagtttgcgaatttttgtcttaggaggagagcctttatttgtgaaagaactggctgaatggcatcaaatttttggctctcagacagaatttgtgaatatttatggggcaagtgaaactacatttgttaagcatttttatcgaattcctaaccctaataatattccctatgaacgggttccgggtggtcaaactttgccagatgccgcttatgcagtggttgatggaaatcgcgccagggcaataggagaagtaggagaagtgttcgttaaatccccctatttaaccaaaggttattatcaagatgaaagcttaactcattcagtttttgtgcctaatcctttgaatggggggagggatatagtttatcgtactggagacttaggcagactgcttcctgatctaactttagaagtaataggacgcagtgacaatcaaattaaattaaatggggtacggattgaattaggagagattgaagatgtcctcagtgggattgagggagtagaaaaagccttagttatggctaataaaaaggaggaattagtaaacgtaattgcttattatcaagccgaggatacagttcatcaggaatatattcgaggtaaattaaagcaactcttaccgatttatatgcagcctagctttttaatgcggttagaagcttttcccttgttacccaatggaaaaattcatcgtctagctttgccaaaacccgaagaaaatattactaactcaactaaccaagtcccagattttaatccacaagaagctttattagcttccctttggggtgagttattagaagcagaagttagtaacagtaatcagtcattttttgaactaggaggaaacagtctgaaggcgatgcgcttagtgtcacaaatccgtaatcaatttggagtttctctccgattacgggaaatttttacccataatactttaaaagaacaagctgtattaattcaatcccgacaaaaacgatga

SEQ ID NO: 83 - DNA, 6381 bp, Microcystis aeruginosa
atggcagacacaaaaaatcaacccgccaaaaatgtggagtctatttatcctctttcccccatgcaggaagggatgctctttcatagtctttatactcctgattcagggatttattgtagtcaaactctaattactctggagggagaaattaaccttgcagtttttaggcaagcgtgggaaaaggttgtagagcgtcactcggtattaaggactctatttctttgggaaaaacgggaaaaaaccttgcaaattgtgcgaaaaaaggttgatttgccctgggattatcaggattggcgcaatctttcccccacagaacaacaacagcgtttagatttattgttacaaacagagcgtcaacaagggtttgaattcaaagttgctcctttaatgcgctgcttgatgattcaactatcggaccaaacttataaattcctctgcaatcatcatcatattattctggatggttggagtatgcctattatttatcaagaagttttagggttttatgaggcaggtattcaagggaaaagttatcatcttcctttgccgcgtccttatcaagattatattgtttggttacagcagcaaaacccatctattgctgagagtttttggcagcgaactcttgaagggtttatgactcccacccccatgagggtggacagactccaattaatgaaatctgaaggtaagccgacttataaagagcataactgtcatttatcggcttctcactccaaagatctgcaatctttggcgcaaaagcataatctgaccttatctactctagtacaggccgcttgggcgattcttctcagtcgctatagtggggagtcagaaggtttatttggggttacggtttctggtcgcccccatgatttatcgggggtagaacatagggtaggattatttattaatacattgccgctgcgagtctccatcagagaatcagatttattgctatcttggttacaggaattacagcaaaggcaagcagaaattcaggattatgcttatgtttctctggctgaaatacagagattaagtgatattccaccgggggttcccctgtttgagagtttggtcgtttttgagaattatcctagggaagcgttatcgagagattctcgtcaatccttaagggttaaggatgtggagaattttgaggaaactaattatcctttgacggtggttgctattcctagacaagagttactgattcagataatctatgatactagccgttttactcaggatacgattgaacggatggcaggacatttacagactattttaacaggaattgttactgatcctcggcaacgggtaacacaattacctatattgacaacacaagagcaacatcagttattagtagagtggaacaatagggaggctgattatcctttagataagtctttacatcaattatttgaagaacaagctgcacagaatccgcagggaatagtggttatttttgaagaccaaaaattaacctatcaacagttaaataaccggggcaatcagttagctcactgtttacgagataagggtgtaggtctagaaagtttggtcgggatttttatggagcgctccctagagatggtcatcggtttattagggatattaaaagccgggggagcttatgtacctttagatccggattatcctaccgagcgcttgggggatatcctctcagattcggatgtttctttggtgttaactcaggaatctttaggggattttcttccccaaactggggccgagttactgtgtttagatagggattgggaaaagatagctacctatagtccagaaaatcccttcaatctaacgactcctgagaatttagcctatgttatttatacatcaggttcaacgggaaaacccaaaggcgtgatgaatattcatagaggaatttgtaatactctgacatatgctattggtcattataatattacctctgaagatcgcattctccaaattacttccttgagttttgatgtttcagtttgggaagttttctcgtctttaatatctggtgcttctctagtcgtggctaaacctgacgggtataaagatatagattatttaatagatttaattgtgcaagaacaagtaacttgtttcacttgtgttccctcaatattgcgagtttttctgcaacatcccaagagcaaagattgccactgtttaaaacgagtaattgtcgggggagaagccttatcttatgaactcaatcaacgattttttcagcagttaaactgtgaattatataacgcttatggaccaacagaagtagcggttgagactactatctggtgctgtcagccaaattcccaaatttctattgaactccccattgctaatgcccaagtttatatcctcgacagttatctccaaccggttcctattggtgttgctggagaattacatattggtggaatgggtttagcgcgtggatacctcaaccaacctgaattgacggctgagaaatttattcctcatccttttgctcaggggaaattatataaaacgggggatttagctcgctatcttcctgagggcaatattgaatatttagggcggattgataatcaagtcaagctgagaggtttacgcattgaattaggagaaattcagacagttttagaaactcatcccaacgttgaacaaactgttgtgattatgcgggaagatagctcagacaatcaacggttagttgcttatatagtcagaaaatctccctcattaactctcggagtattgcgtcgtttcttacagcagcaactgcccgcttatatggtgccttctgcctttgtcctgttgtcggattttcccttaaataacaatggcaagatagataggaaaaaattacctatccccgatgagacatcaattattgaatctgcttatatagccccaagaaatgaaaaagaaagcctcttagctcagatttggcaagatgttcttcaggtatccaaaataggggttagtgacaacttctttgagttaggaggacatagcttaaaagctatttctctagtgagtaaaattcaggaaaagttaggtcaatctttgcctattaaacaagtatttgctcatcctaccattgctgaacaagcagtattattaagcactgttacccctctgacggtagccactattccccttgtatctgcacaggaaacctacgaaacatcccatgctcagagacgtttctatgtcttgcaacagatggatctcaataatgtagcttatcatattgtttccactctcaaaatagcaggagattttagcccagatgtctttgaaaaagccatacaattattgatttcccgtcatgaatccctgcggacatctttcattttaattaacggtgaaccacaacagaaaatcctgcaaaatcgtccttttgattgggaatttaaagactggacaaataaacctgatgaagaaatcctagaaacgattgcaaaagagagaaaaccgtttgacttagagaaaagtcccctggtgcgctctaagatttataaactatctccgaatgaatatattttagagttagaaattcatcatattatctgtgatggttggtcaatgagtttgttagctaaagaatgcttacaatactactctgatttagccaaaggattacagcctagtatagagccattgccgatacaatataaagattatgcagggtggcaaaataatcttttaagaagcgaaaataattcaaaaaacctagattactggcggcaaaaactggacaatggacaactgaccagagttcacttaccgacagactttaaacgtccccaaataaagacgtttaagggttctcatttaagctggacatttgaccgagaaacgatttctaaattaagaaaaatttgtcaagaaaacgaaatcaccctattcatggcattggtagcggctgtcaaaatattactgtatcgctacagtggtcaacatgatattactattggtacagaaatcgctaccagaagccatcctcaactgcaatctctaatcggtttatttctcaataccttagttattcgtgaccaaattgaacccgaaaaaagctacaaaaatctactcgcaaaggttcgtcaaaccgttaccgaagccttagaacattccgattatccctttgatattttagtagaaaaattagctgtttctagagtcattagccgcactcccttgtttgatatattagtccttctgcaaaattttgatcaacctgtaggcttgggaaatatacaaataaaatctctagattccctgaccccgaccagtaagtttgatctatcttttgtgtttagtgaagatcaggaaaaactcagattagagctaatttataacaccgacttattccaagaggagaggatgaaaaaatgtctcattcacttcgataaactcttgaatgaaatgctatctaaccccgcccaacccgtcaaagacatttctttgttatcggaggcagaaaccgcttttattgccaattttatcaatcctattcctcgcttagaaacccgtactattatccacgattttattgaccaagttgcagccaaaccagagaaaacatcgattatttatccagggggtaaatttaactatcaagaattacatgaactaactaacttttgggcttatgccttaaaagaattaggcgtggaaaaagataaggtttgtggtgttctcctagaaggagattatcgtcagttaatcgctatgctggcagtatttaaagccggaggaatctatttacctctacgtttagatgaacccgaggagcgccggcaacgcatgatgattaaaactagccccgaaattatcttagttgcggctgagaatttagaggggattaaaccccaactatccgcattagaaaaaccgcctcatatcttagtggttaaggctcataaaattcagcaatatcatcagtggaatggcatggattatcaagagtttccttgccaattaagcaaactgcaaccccttctagctatgccggatgctgatgattctaattatattatgtttacttctggctcaacccgtgaacctaaagcaattttaggcagtcacggcagcttacgtcatttcattgattgggaaaaacgggaatttggcattaatgaaagttggcgctgtttacaaattgctcaaattaattttgatgcttatttgagggaaacctgtgtgactttatgctcagggggaactctgtatattccagagagcacagagcgagaagacttagagcttttattactgcgaataggagaatgggaaatcaatttactacacactggcccctcggtaatgcgtctgtttttaaagatagggcgtggtttagttaatgcacataatctcctgaaaagtttgcgaatttttgtcttaggaggagagcctttatttgtgaaagaactggctgaaaggcatcaaatttttagctctcagacagaatttgttaatatttatggggcaagtgaaactacatttgttaagcattttcatcgaattcctaaccctaataatattccctatgaacgggttccgggtggtcaaactttaccagatgccgcttatgcagtggttgatggaaatcgcgccagggcaataggagaagtaggagaagtgttcgttaaatccccctatttaaccaaaggttattatcaagatgaaagcttaactcattcagtttttgtgcctaatcctttgaatggggggagggatatagattatcgtactggagacttaggcagactgcttcctgatctaactttagaagtaataggacgcagtgacaaccaaattaaattaaatggggtacggattgaattaggagagattgaagatgtcctcagtgggattgagggagtagaaaaagccttagttatggctaataaaaaggaggaattagtaaccgtaattgcttattataaagcagaggatacagttcatcaggaatatattcgaggtaaattaaagcaactcttaccgatttatatgcagcctagctttttaatgcggttagaagcttttcccttgttacctaatggaaaaattcatcgtctagctttgccaaaacccgaagaaaatattactaactcaactaaccaagtcccagattttaatccacaagaagctttattagcttccctttggggtgagttattagaagcagaagttagtaacagtaatcagtcattttttgaactaggaggaaacagtctgaaggcgatgcgcttagtgtcacaaatccgtaatcaatttggagtttctctccgattacgggaaatttttacccataatactttaaaagaacaagctgtattaattcaatcccgacaaaaacgatga

SEQ ID NO: 84 - DNA, 3876 bp, Microcystis aeruginosa
atgatcaacttaccacaatctgactcaattaacccactggaaaaacaaaaatattacgaagtctctcacggtcaaagaaggctttggattttgcagcatatcagcgaatcttctagtgcttataatattaggcttgccatgagaattaatggcaagttagatgtttctatattaacagcagcctttcaagaactggtgaaccgtcatgaaattctcagaaccacttttaccagtgttgggggcaatattaagcaagttattcatgagcaaatccccacagaacagttaatcatttttaaagatttaagagaagaaaaagatgctgaactcttggcagatgatttaattcaagagtcggcaaatttaccttttagtttagaaaagttgccccttattcgggtcttattggtgcagattaagtcagaagaatttatctttggtttgactgtccatcatattattggggatgcacaatcacttgatattatctttcaagatttctttatattatactctgcttatactcaacaaaaaaaagctgaattaccccctcttactctacagtataaagattatgcggcatggcaaaatcagtggttagaaagtgaagaagttagagaacaacatgagtattggtgtgaggttttttccgaacatccccctatcttaaacttaccgatagacttccctcgacctcaagtaaaatcttctcaagcggcttcctacacttatcaatttagtgagagtcttagccaacaattacaaacctttgcaactcgaaatcagacgactctatttattaccctactgactttctttaaaatattactctaccgccacaccggccaacgggatttagtagttggtatccctatttcagcacgaaatcatcctgatttagaaaaccagatcgggttttatgttaacaccttggctttgagatctttattaccagagggagtaacttttaagcaagtcttaggggaagtaactaacacctgtcttgatgcttatgaatatcgtgattatccttttgataaattagtatccgctctcaatttagaacgtgatttgtccagaaatcccttatttgatgtcatgttttctctactgggtaaagaaagcaaaactgtcttaaaaattcctggtttggaacatcaaccttatcccttaaaaccacgcatggctcaatttgatatgacttggagcttctttgaagatagtcataatcttacattagtgatcgaatatgagccagatttatttttgcctgaaaccatcgccagaatgaacggtcactttttacaaattattaaaagtgtaattcagaatcccgattgtaaattatctgagattaatttattaacccctgaagaacagcatcaattactaatagagtggaatcaaaccgaagtcgcttattctcaacagtgtttgcaccagttatttgaagaaaaagttagagataatcccgaggcaatagctcttatttttgacggcgaaaaattgacctatcgagagttaaataatcgagctaatcaagtcggtcactatttaaaagaaaaaggcgtaacttcagaagtattagtggggatttttattgagcgttcttttgagatgatcatcggaatattgggaattattaaagccgggggagcttatgttcctttggctcctaattatccccctgagcgcttggattatatgatatctgattcggcgatttctctgttgttaactcagcaatctttagttcaatttctgcccgaaaatcaagccgaaatactgtgtttagatacagattggttaaagatagctaattatagtcaagagaatttgacctctccagttaaaccagaaaatttagcttatgttatatacacttcgggttcaacgggaaaacccaaaggtgtgatgaatattcatagaggaatttgcaatactctaaaatacaatattgacaattataatcttaactctgaagatcgcattctccaaattactccctttagttttgatgtttcagtttgggaagttttctcatctttaacatctggtgctaccctagtcgtggctaaacctgacgggtataaagatatagattatttaatagatttaattgtgcaagaacaggtaacttatttcacttgtgttccctcaatattgcgagtttttctgcaacatcccaagagcaaagattgccactgtttaaaacgagtaattgccgggggagaagccttatcttatgaactcaatcaacgattttttcagcagttaaactgtgaattatataacgcttatggaccaacagaagccgccgttgatgctactgtctggtgctgtcagccaaattcccagttaattcctattggacgtcccattgctaatgcccaagtttatatcctcgacagttatctccaaccggttcctattggtgttgctggagaattacatattggtggaatgggtttagcgcgtggatacctcaaccaacctgaattaacggctgaaaaatttattcctcatccttttgctcaggggaaattatataaaacgggggatttagctcgctatcttcctgatggaaacattgaatatttagggcggattgataatcaagtcaagctgagaggtttacgcattgaattaggagaaattcagacggttttagaaactcatcccaacgttgaacaaactgttgtgattatgcgggaagataccttatataatcaacggttagttgcttatgtaatcagaaaagatactttattaacttcccaggatttgcgtcgtttcttacagcagaaattacccgtttacatgatcccttctgcctttgtcatgttgtcggattttcccttaaatcctaatgggaaaatagacgttcataaattgcctataccggatgagacttctctagttgaatcaccctatttagccccccgcaattcaacggaaactatcttagtaagcctttggcaacaacttctacaagctggcaagataggggttaatgataacttctttgagttggggggtcattccttacaagctatgaatcttatggctttaatttatgaaaaaatggccatagaaattcctttatcaatgatttatgaaaagccaacagtagccgaattaagcgattatattatctatgctcaggagatgaatattcaaccgaaagaacgtccttatgtggtgtttaataaggagcaagaaaaggccgtctttttatttccacccgcccttggtttcgctgctgcttatgccaatttagcagagtatctaacgaattatgctatttatactttccggtatattagcgatgaattaatgttaaaaaaatacgctgaattaattgaggatttggctcagaatcaagatataaaattaatgggacattccgccggcggatttttagcgatgttaatggcgcaacaattagaaagtcgagggagagttgtttctgatgtcattttactggatacttacagaggaggacgtgaggctaaaaaagctgatatgtcagagattcaagaaggggttgatgctttcttattaaatcccaaacgtcaggaattaagaggttactttttagaaaatcaaaaactccgcaatcgcacttataatcaagtgtgggaatactttaattttctttggaattctgacttaaaaaatgtacaaattcaagggactattcatttgattcgtgctgagggaaactatgaagctcaagatgattggacacaagcaacaaaaggagaaagaatcaatcattatgccactggtattcatcgtgaaatgattgatcctccttatcttcccaaaaacgctctgattattaatagtattctcaacccaaaacagtcgtaa

SEQ ID NO: 85 - DNA, 11706 bp, Microcystis aeruginosa
atggactttcaagataaaaagaacttatccgaaaacgaccaatcaatccaaactagagtttttaaagctcttagtgaagctaaagaaaaattaaaagctttcgagtctcaacaaagcgaacccttagctatcgtcggtttaggttgtcgtttcggtcataatattgcgacacctgaatccttctggtctttcctcaaagcgggtaaaaataacctcagagaaatacctaaggagcgctggaaccagcaggatttttatgattcagatcggaataaagtgggtaaaatctatgtttctcagggggggtttcttgatgatgtctcccagtttgatgcccattttttcggaattgctcccaaggaagccgtcgctatggatcctcagcaaaggttgcttttagaggtagcctatgaagctttggaaaatgcaggaatggcaacaacgacggctagaaggggaaaaacaggggtttttatcgggattaccaacaatgactatgcccgtattcttacctcaaatgaggactataatgccatcggagcctatcatatttcgggtaatcatactaatgcggcagctgggcgtatttcttaccttttaaatcttaatggtccgagtttggcagtagataccgcttgttcttcttccttagtcgctgttcatctcgcttgccgttccttacgttcccaagaatgcagacaagctttagtcggaggagtgaacttagttttaactccagaagtcgtcatcgccttgtgccgcaatcagatgttggccccagatggccaatgcaaaacctttgacgaaagtgccgatgggtttggaatcggcgaaggttgcggagtcatcgtcttaaaaagactcagtgacgctcttcaagatggtgatcacatttgggcagtgattcgagggaccgcagtcaacaacgatggagctagtggcggctttaccgttcctaatgggcctgtgcagagagaattaatcagagaagctctggctgacgctcgtttagatgccgaggcgatcgattatgttgaagctcacggtacaggaacatctttgggagatcccatcgaaattaaagccatagccgaggcattatgcctcaatcgtcggaaatctaacccgttattagtcggttctctcaaaactaatttaggtcatctggcggcggcggctggaatttcaggattaattaaaaccgcattatcgctacactaccgtgaaattccggctcatctaaatctcaaaaaacccaatcctcatattaattgggatgccttgccgattagtatcgttacgcaaaattgttcttggaatgttaataatggcaagctcaaagcggctggagtcagttcttttggagcatcgggaaccaacgctcatgttattttaagtgaaccgcctcaaccgcaaccccaaaccccaaaaatatcccccattctcgttactttctcggctaaagaacccgaacgtttacgtctttttacgactcaatttgtcgatgagcttgagcagaaaacagatctcagcgtcaaggacattgccctatctttaaataccggtcgttttccccataaacatcgtctcgctcttttagtttctaatcaagagaatctgcgccaaggcattcaggcttttctcaagagcgatggggatgaaaagcaatttcaaaatattcaaaataatagcttcgacatcatttatggagaagcgcaaagcaatcctaaaattgcttttctctgccatgacgagcaagaaattagtctagaaatcattgaaaccctgctcaataatgagccaatattttatgatgcttttaggcactgtgatcatctgtttaaaaaatatttagaattttctcttcaggaattattgtcatctaaaaaagccttagagcctcagattcctttgtctgtacaaccggtattatttgcctatcaatatgctctttgtgaactctggaaatcgtggggaatttctccttctgcgattttaggttctggattaggggaatatctcgccgctcaacaagcgggcgttttttcccttgaagataccgtcaagctggtggcaaaacgcgctcaaattagcccacaaaaccccaactcagaagaccttttatccttgctcaaaagcaccccagaagtcgattctaactctcccgatattaccctaatttatcagggtgaagtggtgaaaaaatctctcaaaaattccgtgaatagaggggaaaggattaggcaaaaatccgacgaaatcgcccagggaatttctactttgcatcaaatgggatatcaaatattcctagaaatgggaatcagtgccaatctcattaatataggtcgtcaaaagttaggggtaaattcaattctatggttatctagtttaggggaagattgtcacagtgatcagcatgagcaaagggtgctaggtcaactctatgtacgaggatttaatattaactgggaatcctttcatcgctcacatccggggcaaaaaattagtttacctaattcgccttttatccgcaaacgctactggataaattctggcaataaatcagagtcttctagctataaaaaccctaattattactctggacatcccttactaggcgatcattttccttctcccttagctctccttcaatatcgagggagcattagtcaacataaacctgcatttttaggagaacatcaggtttttgatcaggccatattgccagcatctgccttgatagaaatggctttagctgccggggagaatcaaagagttattttagaaaatgttgaatttaagaaggcattaattttaaaagatacggaagacacattacagttaatcattgagcaaaaaagctttaaaatttaccatgaacttgagccaaattgggaaatattagttactggaaaaattgaggaattgaaatcaactaatttaacccattgtcatctagaagaaatcgccaaaaattgttccgaagaagtcgatatcaactccttttatgaaacttatcaaaaatcagggataaattacgggagtaactttcggctcattcatcaactgaagcggggggaaaatacagcttttgctcaaatcaaattaaccgataggttagagcgggaaaaatatcatttccatcccgctatgttagacgcttgttttcaagggattgctgccattttatttcaagaagaatcctcagtaacttatgttcctgttcgccttgggcaattggcattttttcaccctcctgatgagcaggtaatcagcgcggttcgactgaaaaactcctcccctaaccctaacattatcatcgctgatattgatatctattccccccaaggtcaacccttagcatccctcaccaacttagaactaaaagccgttcaatctcaagagattatcccccaagaaatcccccctcaaatctatctagaagaatggatgccttgcgaggaattattagggaatggtagagacactttagtagctccccaggtgattcaaaatcaaattcaccccgcacagttagaacaacaactaggggaaaaattggggcaatatgagcgcttaatggaggccttagaaaagttaagcgtaacctatatttgggaagccttaacaaaacttaatggacagccaaaatcaggtcaaacttattccgaagcacagatagcaaatcaaggtcaaattgtcgatttttaccgacctttattatctcgatgtttaagcattttagctgaagaaaaaatcgttaatcagacaaaagatggctggttattcgtcaaagaattagaagcaccttcatcgccatcgcaaattaaaattctccgccaagaatttgccgattatccagcagaaattagtctcatggagcgttgtggctctgctttggcagcagtcatgagtcgtcaagttgagccattagaattactctttcctcaaggggatttagaagcgatcgcatcaatttattcggaagctgccggagctaaattgatgaatcagttagtcgccaccacaatccgccgtgctattgagaatttcctcccccattatcccctaagaattctcgaaattggaggaggaacaggagccgttactgctggcattttacctcacttacccacagaacatatcgaatatgtattcaccgatatttcctctagtttcttaacaagagccaaggaaaattttagaaactatccctttattaaatatcaaactttagacattgaaaaaaatccctttactcaagattttctccccggcagttttgacataatcatcgccgctaatgttcttcatgccacagccaaccttcaaaaaaccctggaaaatgtgcgctctctcatcgctcctaagggactactaatcctcttagaaagtacaggggcaagacgttgggtagatttaacctttggcttgacagaaggatggtggttatgtagtcaagatctgcggcggaatggttatccgttaatcagcacaaaagattggcaaaatttactgattgagaatcaatttgaagacattaatattatcgaaccaagccaagcaaaaacccgaaatttattaaaacaaagtgtcatcattagtcgaagcagtgagcaattaccttctcttctggcaaaatcttactatcatcaaataatctgggcagatagtcaaggaattgctaacggtttaatccctctattccaacagagaggaataagttgttcttgcgtcttttcccaagatattaacctggagattgctgaagattacctatcaatattgagaaactcgataacttcagaaactcgtcaaatactgtacttctggggcttagaaaaaatccctggagaaatggatcaacaagtcgagattcattgtcaaagatttctctttttcttacaagccttattgcagcaagaaaatccgccggctctgattttagtgactcaaggagcagtaccagcaaaagccattaaaaccctgacctctccctctcaagcatccttattaggaatagccttcagcctagtcttagaacatcctgaacttaattttaaggcgattgacctagatccagatgaagtaaactcagccgacaaactgctgcaagaaatctacagtaatccccaagaaaaccgggttgctttgcggggggaacagcgtttttatccccgtttagtgcagagaaaacttgaagatggaaatatcaattttagtcctgatggctattatttaatcacaggaggcacaggggggttaggattagcaacaacccgatggatgattgaaaaaggggcgcggaatttagttttgtgtagtcgtcgaggggcagaaggagttagccctgaaatattagccaatctctcctctagtggggcagaaattaccctcaaaaaacttgatattaccgatgctgaaaaactgcacactgtcttagaagaatgccgttctaaatatcctgtacgaggcgtttttcacattgctggaaccttagacgatacaaccttattaagactaacaccagagcgctttaattatgttttagctcccaaagttaaaggaacttggttgcttcatcaactcaccctaaatgacccattggaattctttgtctgttatacttctgctgtatctttaattggctcggcaggacaagctaatgctgcggcagctaatgcctttgaagacgcttttatctattatcgtcaggcgcatcatttacccggaacggtcataaattggggtccttggagtgaaataggtgcagcagtagatcgcaatgttttggagagattagccgctaaaggatatggggctatgaaacccgatttagcccttaatgctctggaaaaaattcttctaaatcagattatccgcgctggtgtaattaagattgactggcaacaatttccttatattcatcaaagcttttataaaaactttctgcctcaaggaaaaccccaagctgccccctcatctgagtttttaaaacaatggcaaaatttaaccttaaaagagcgtcctaattggctaactaatcatatcatcatgcgtgtttctactgtcttaggacgctcaaatgatgaaactttttcccctcaacaaggcttttttgatttggggatggactctctcacttctacagagttacgaaatctgttacaaactgactttaattgttctctcccttcgacaattacttttcgttttccgaatgttgaagtcttagctaattatttacagcgagaagttctagataattgtcaaccggtatttacccctcaaataaaagcagaaatttctcaaaaacagccagaaaaatcacaactcgatgatgatcctattgttattgtcggcatggcttgtcgattccccggcggtgctaagaatttacaatctttctgggaacttttagaacagggaaaagatgctataacagaaattcctcaagatcgctgggatcaggaaacatggtatgatcctaatcccgatgtccctggcaaaatatacgctccttacggtgcatttctagaacaaattgaggaatttgatggagaattttttggcattattcctagagaatctgtcgccatggatcctcagcagcgtttactcttggaaactacttggcaagctttagaatctgctggacaaaatccccaaaaattacgcaacagtcagacgggagtttttatcggttgcatgactcaagattatgcccaattaagttattctcctcaagccattaatgcttatactggttcagggacttctgttagtatggcggcgggtcgtctttcttatgtccttggtttacagggtccatcaatgactattgataccgcttgttcctcctcattagtagcgattcatttagcttataatgccttacttaatggtgagtgcgatctggctttagccggaggggttaatattattttaactcccattatttctttaatcgaaagtcgcgcccatatgcttgcccctgatggacattgcaaaacctttgatgagagcgcaaatggcatggtgcgaggagaaggctgtggaatagttgttctgaaaagattgagccaagcagtgaagaatggagaccaaattttggcgaaaatttatggcacagccgtcaatcatgatggtccaagtagtgggctaactgttcctaatggtcaagctcaagaaaaattattacatcaagcccttaaacgtgctaatctcaagcctgaacaaatcgattatattgaagctcacggcactggaacagcccttggtgatccgattgaattagaaagtatgtccgccgtttttggccaacgctcccctaatcggcctttaattattggttcagtaaaaacgaatttaggccatttagaaggtgctgccggaattgccggattaattaaaaccgttctagcgttacaacaccataaaatacctcctcatcttcactttaaaaatcctaatccccgctttgattggagttctcatatttttgaagttcctgtacaaggaaaaccttggcatatcagcgaacgtccaaggattgctggagtaagttcctttggatttagtggaacgaatgctcatatcattgttggggaaattgacgctgatttacctcaaccttcggagaataatttttatctattacccctttcggctcgttctgaaaaatcgctgcaagagttagcgagaagttatcaagatattttgactgagtctatcaatttagctgatgtttgttttaccgccagtacagggcgggggatttttccgcaacgaatctgtattttagcagactcaataaccacggcacaacgagcgttaattgattaccaagatggtgaaaattctgactcattcatccgaccgattttatcagagactccacaaaagatagctttcctcttttctggacaaggctctcaatattccggcatgggagaaaccctttataaccgagaagttgttttcaaggaaacattagatctttgtgatcaaattttagaaccccttttagaaaaatctctcttagatttaatctttcaagagcaaaatagtgagttattagaggaaacccaaatcactcagccggtgattttttcccttgaatatgcactcgccaaattatggcaatcttggggaatacaaccttcagcccttttaggacatagtattggggaatatgtggcggcttgttgggcaggagtcttttctttagaagatgccttaaaattagtgactcaacggggtaaattaatgggaaaattgccccacaatggcagtatgtccgctatttatgctgattatgagacggtagcaaacgctctaacttcgtatgaaaatcaagttaatattgcttcagccaatggctcaattaccgtcatttctggatttaaagagattgttgagcaactcgaaaaagactttattgatcaagggcataaaactaaacgtttagcggtatctcatgcttttcattcgcctttaatgcagcccattcttgatgatttttcccaggtcttaaaaacaatttcttttcatgaacctagcttaacaattattagtaatctgacagggaaagctgtaggttcagaaattacaactcctgattattgggtagatcatctgcgtaatactgtacagtttagtcaaggatttcagtctttaattgatcagggttatcgttgttttctagaagtcggttctaagcctgtattactgagtatggctcgccttattgctgccaaccaggatctattatggttgcctagtattgtacccgggcaggatgaacaggcacaaatgtatagaagtttagcgacactttttgttaatggttattctgtagagtggactaaagtatttaaacaaggtaagcgaattagtttaccgacttatccttttcaaagagaacggtattggctatctaattcggaattttctctagggtcaatcaagactcagttacatcctttcattagagattttaaaaagttagcaacgggagacatgatctttgaaggtgaggtgagttctcttaaccctagttatttagaagaacacaaggtatttgagaacattgtatttccagctactggttttattgaagctattttagccgcaagtcagaaaatattcaatgggcattttgtcacccttgaaaatgtctctatccatcagggattactcttatctccaactccctcaataatccaaataatttttagacctaaaaaatcatctcaactgatttatacttttgagatatttagcagtgattctgcacaagaacaatgggttcttcatgttacaggtgaagtcaaacctaaggatatacaaagcttggctgtctcagaattaacccaaactaaattagaaagggaaaaccctaaagaatcgatttctattcgtgaattctatcagctttatcagcagatgggtatcaggtatggggagcagtttaaagcgattcaagagttatattctttcaaaaaaggctctcaagctaaaattagtattaaccctagtttagcggatcggcgttattattttcatccagttcttttggatgcttgcttacagagtattggggcagctttcccagaaattcatggtcaagaattgcatctaccttatggattctcttccttggaaatattcctaaatccaacttcgcaagtttggacggaagttcaggtcatctcagatactaatggtgaaatgagagtaaatgttaatatttatgatgaacaaagacagctttgcgctcgctttactgacttaacagcacggcgcataaatccagctattttacagagtttatggcaagaaaagtcaaataattgcttttataaagtggaatggaaaaaactttcttcaatgccaactgttgccgttgatcctcaaaattcttggttagtcttggttcgtccagaaacagacttaaattccctaattaatttatacaaaaaggcaggagaaaaagtaattactgtagaaatggggcagaattatcaatgttattctcaagattcttttgtgatcaatccggctcagaaatctgattttcagcgtctctatcaagaagcttatccatctggagaatttccgactggtgttgttttttgttgggaatcttcagaagctgaagaagttctagatacagtagatcagagttctcatgccgtcttaaatttagtgcaaaccctcactaataactgggagaaattaccccatttatggctgattactcgcggggctaataagattagcaatgatacggctttatctcctcaacagtcccatttatggggattaggagcagtcattaatcaagagtatcctaaaatgggttgtgtttgtttagatttaccaatccataaagaagctaatgaagctgcacttttattcaatgaattaaagtgtttcccccatgaattccgtttggctttacgtcaaggaaaccgctacgcagccaggttagtttctgcatctcttcctacctcagaaaaacgacagtttattaatcagtcaggggcttatttaatcacgggagggggaggaaaactcggcggattagtggctcaatggttatcagaaatgggagcaagtcacctagttttgtgtagtcgccatgttaaatcttcaacagaattgatagccccattagtagagaaaggaacaaaagtaaccttgattgaagctgatattacttcccccacagatatgaaaaatttattctctcgttttggggcagacttgcccgtcttacgaggaataattcatgcagcagcggtcttagaagatgggcttatcagtaatcaaagttggcaaaaatatcaaaaggtaatgagtccaaaagtagcaggaactttattattagatcgttatactcgctctctatctttagactttttcgtaagcttttcttctgcggctgtcatccttggttcaccgggtcaaagtaattatgcggcggctaatgctttcatggatgctctaatgcagcaacggcaaagtttaggattacctggtattagtattaattggggagcttgggagacgagcaaccaaattgatcaacaacgtttcgctaattggggtttgcagatgatgccttctgagcaagcgtttcaatatctcaaccagataattttagatgatattaccccagggatagttctcgatattaattggtcgatttttaatcaaactttcaacattagtcaacccttctttagcgaggtattaaccctaaacaatcaaaaacaaacaagtccagcaaaactattagaacaattaaaatctgtctctatagacgaacgaataaccgctttagtagaaggactggagaaaatattaagagaagtgacagggttaaatgagaataaggttattcctcaacaaacatcattcttagacttaggtttaaactctctaatggtcatagaatttaaaaatcgcttagaaagagatttagggtgtaaattgccatcttcgatcattttcgattatcctaatcttctcagcttaagtacctatttaagggaagaaattctagccaatcatctcgattttgagattaaaataaatccaattcctgacaatcataatccctacgacagcctcagtgaagacgaactggcaagattacttaatcaaaaattaacggagcttgatcaatatggaggttaa

SEQ ID NO: 86 - DNA, 11706 bp, Microcystis aeruginosa; identical to SEQ ID NO: 85

SEQ ID NO: 87 - DNA, 10464 bp, Microcystis aeruginosa
atggttgagagtatagattacaaaaaattaatggcaacgaccttaagcaaaatggaggtcatgcaggctcgtatcaatgaattagagacgagacaaagtgaagctattgcggtggttgggatggcttgtcgttttcctggaggtattaattccccagaaaaatattggagtttttgtcaagccgggcttgatgctatagtagaagttcctaaaagccgttgggatatctcaaaactgtattctcaagaaccaactttaggaaaaatgaacaccgcttatggtggatttcttcaagagaatatcacagaatttgatgcccgtttcttttcgatctcagcaagagaagcagcctccatggatcctcaacaaaggttactcttagaagttgcttgggaagcgttagaaaatgccaatttacctctgaaaaatttagccgataataaggtaggggtatttgtggggattactagcattgatcatgctctgaaggtttacggcacaaactatgatcaaattgactctttttttggcaccggcaatgctctaagcgcagccgccggaaggctatcttattttctcaatcttcacggtccttgtctctccattgatgcagcctgtgcatcctcattagtagccgtccatcaggggattcgtagcctgagaaatcgtgaatgtgaactcgctttagtgggtggggtaaacctcattttagaacccgccattacgattagtctttctcagtcgggaatgatgtcccccgatgggcgttgcaaaaccttcgatgcctctgctaacggatatgtgcgaggggaaggctgtggggttttaatcttaaaaactttatcagaagcccagaaaaacggggatcacattcttgccctgttgcgaggttcggcggtgaatcataatggggctgctgccggtttaaccgtacccagtggacccgcccagcaagaattgctccgtcaagctctagctgatgccagaatagtccctgaagatgtcagctacatagaagctcatggcacaggcacttctttaggagatcccatcgaattgaatgccattgcatcagtttatggaaagcgctccgaccctctttatatcgcctcagtgaaaaccaatatcggtcatcttgaagccgcagctggcatggccggaataatcaaaacaattctgattcttcaacagggtgaaatcccctcccatcttcacttacaaagccctaatcctctgattaattgggaagatcatcctattaaaattcctactcaaaatataccttggccgaataacaataaagtccctatagctggggtaagttcttttgggttttctggcacaaatgcccatgtcattgttcaacaagcacccgtcagcaaaatctcagaaattcaacaacaaattcctagtcatctcttaactctttcagcccacaacaaaaccgctttaaaagaattagctaaacgttttcataccctcctagaatctcatcctgaaattggagatatttgttatagtgcagctgtcggcaggatagatttacctgaacgtttagccattgttggcgatacttgtccagaattacaacaaagattagccgcttttgctgaagaaaacccgcttgatgatttgactttttatcaacgttttacatcggaaaaatcccctaaaattgtttttctttttacagggcaaggggcttgttatcctggcatgggacatcaactctatcaaactcagccgacatttcgtcaatatattgatcaatgtgccgaaatattagcgaagtatttagaccatcctttaactgaaatattatttggtgaacagaccgatttactcaatcaaactgcttacgctcaaccggctatattcgccctagaatattccctaacaatgctatggaaatcttggggaattacccccagtttactgattggccatagtgtgggagaatatgtagcagcttgtatcgcaggagtatttagcttagaagctggactcgccttagttgtcaaacgggggcaattaatgcaaaccacgacctctgggaaaatggcttcaatttttgctgatgaagagacagtaatttccctaattaaaaattatactcaaacagtttcaatagctgccattaatcaccctcaacagattgttattgctggagaaagtgccagccttgaggaagttattagcacctgcaaaaagcaaaaaattcccgctcaatatctccccgttactcaggcttttcattcccctttaatggagccaattttaaaagaatttgaaaaagaggctcgtcaaatttcttatcaacgcccccaaattctcttactttcaggacttgatggagaggttttagaaaatgcaccagatgccacttactggagcaaacaatgccgagaaccagtaagatttttgtcgagtttaataaccgctttcaacaagggatataacctatttttagaagtgggaccaagaccaatactggcagaacaaggtcgtcgttataaagatgaggtcatctggttaagttctctcaatcgtggcttagataactggcagacaattctttcagccttgggacaactctacctaaatggcgcacctttcaatccagaacaattcaatcgaaattatggctataaaaaagtcagattgccgaactatccctttcaaaggaaacctttccaatttcagcctaatcctcgaacagaaaatcagagcattgacaaaatattcctagacgcacaaacctctaaccttaccgataccgaaaccacagttttcaatatgcaaaaacatcaacaggaaatccgtaatcaattaaaatcaattttggctttacttctgaaagaagatgagaacgaactgccggaggatgagacattactaaacttaggagcagactcaattatcttgactgacttttctcgcaaaattgaagaaaaatttcaagtcaaagtgaaaatagatcaactctttaccgatttacaaactcttgttgatatcgccgaatacctctgccaatttgtcaaagaaaaacccttagaaaatgcttcagaaataacagctaaagttatcgatgacgagacagaattaagcaattatctgcaagtcattgatcaattgcaacccatcgctacagcctatatcatcaaggctttagagtccttagggaaaaaacttaatcaaggggaacaatggacaatagaaaccctaagacaaaccttacctgttgcccccaaatatcacattttgctcaatcgttatttgcaggatttagagcaagctaatattcttcacaatcaagggaatatttggactgtcaaaaacttgcctgagtctttttccttgccccaagccctacaaaagctagaaaaaacttgtccatctgcaaaacctgaattagaaatgttgcaacgctgcggcgaaaatttagcagaagttctcaagggaaatatggaccccttgacattaattttcccagaaggttccgttgctcatgcagaaagtatttatggcaattctcccgtatctcgattgatgaatcaacgagttgcccaagctattaaccagattttaacgaacttttctaatagtgatcgcccctatcaaattctcgaaataggaggaggaactggtgccacttcagaagcaattcttcaccacttaaacctcgatcatgtcacttattcttttagcgaagtttctcccttcttactgcatcaagctaggcaaaaatttcagaaaaaatataacctaaactttcatcaactagacattgaaaagtcccccatttctcagggtatacctgcccataattatcatattgttgtcgccgctaacgtccttcatgcgacccgaaatattacagaaactctaacccatattcgggaacttctgcgccccggcggttacttagttctcctcgaaaccgtagaaaataactcatggctgaatttaacctttggattaacccccggatggtggcgctttcaggatcaagaattacgctcagacactcccttattaaggggtgaaaattggtgttccgttttaaaaagttgtgggtttgctacggcgaatagtttctctaaacaaaacaatattcccattaacaatggccaagaattaattcttgcttgtgtgccagatgaacccctctcaattcctgcaaggactaagcttactgtctccggtgaaagctccggtaaagaagccttaatgatggctcaattacaatctttaaaagacctaaaagacctccatgagaaaaccattatcaagcaattagaagttcttcaaactgccaccgtctcccccagtatagcccccgaaatattaacgaatcagactcaaatcattcctgcccaaagctctaaaatagaaacttacccgccggtttctcaagagaagcccaaatctcctgagaaacctagttctcccaatttaaaccccttagccttaaagctcactgagaacaaatccttaaccgaacaacaacaagcctttattcaaaatttacagagtatttataaccagaaaaccgccaaatcaaaagcctattcacaaaatagccgtaagacaatggtagatgttaaaccgaccattgacttccgcatggccttaaaagaatttcaatatccgattgtttcagaatccgctcaaggggcttattttaaggacattgatggcaataattacattgacttagctatggggtttggggttaacttttttgggcatagtcctgattttgtcattgaagcagttcaagaacaaatgaatcgaggaataggcttaggaatgcagtcaaatctggccgccgaaaccgccgctttaattagtgaaatgggccgagtcgaaagagtcgcttttagtaatacgggaaccgaggcgattatggcggctgttcgcattgctcgctcccggacaaaacgtcaaaaaatcgttatgtttgccggctcctaccatggaacttttgacggcatcttagcacgagtaggagaagataaaaccactgctcaacccttaagtctaggcacccctttaggaatggttgaagacgtaatagtcttgagttatggagttgaagaaagcctcgatattattgctactcatgctgatgatttagccgccgtattagtcgaaccagttcaaagtcgcaaacccgatttacagcctcaagaatttctgcaaaaactacgacaaataacccataaaaaagggatcacactcatttttgatgaaattattaccggctttcggattgctccgggaggagcgcaagaatggttcaatgttgaagctgatatagtcatttatggtaaggccattggaggaggtttaccaattagtatgatctgcggtaaagcagatttcttagataccgttgacggcggtttctggcaatacggagatgactctcatccccaaaccgagttaaccgcttttgggggaactttttgtcgtcatcctttagcccttgctgcttgtcgtgctgtgctgttacatcttcgggaaaacagcccaacgattcaagaaaaagtgaatcaattaactcatcgattagccaccgaagttaatcagttttttcaagaaataggcattccgattcgggttgttaattttgggtctttattccgctttgaaccctttggagcttatagtattttcttacaacccatcgaattacccctcttttattacctattaaatcttaaaggaatctacacatgggaaaaacgagtttgttttctctccacctgccatactaatgaagatatagacaaagttatagtagccgtcaaagaagcgattacggaattgcagcaagctggtttttttgctaatgctaaacgccctcaagtcaagaaagaagaaaaaaagcccctctctgaagatgaagatggtaggggacatctaccatctttaaatcaatcctttcccaccagtgaagctcaacgtcagctttggttattagctgaattagaccgtaatgcttcagcatcctataacgtcacaacatccctagaattacgaggttctttagatgtttacattttagaaaaaacgattaatcaagttattaatcgccatgaagctttgcgaacccaaattatagaacaaggagaattacaggaagttgtcaatcaagttaacattaaattaaaactaattaatttgaaggatgaagataatcccgaagcgacggccttagcgttacgatctcagttttcccaaaaaccctttgacttgtcgattgctcccttatttgctgtgattttaatgcgcttaaaacctgaccattatctgctgtctttaaaaactcatcatattgtggcagatggttggtcactaggattaattttgcaggaaattggtcaactttattcatcccaaaataacacaactaaagaggttctcacaccaccgatgcagtttcggcaatatttaactttgcgagcgcaagagacgcaaagtccacaaatgttagagcatcgggatttttggttgaaaacctatcaggaagatctcccaacctttgagcttcccaccgactttccccgtcccgccgttaaaacctacactggcggacaagaaagtcaagtcattccctctgaagttgggcaaaatttgcagaaagtaggacgcaaaaataaagctacattatttatgacgatgttcgccgcttatactgcttttttgcgtcgaatttctggtcataaggatttagtcattggtattcctatttctgggcgacaaatagaaggcagtgacaacttagtaggcttttgttctcaatttttacccctgcggatacaagtcgatgctaccacctcttttattgaacatttacaacatactaaacaaaccctgatcgacgcttttcgccatcagagttatactttagaggatttattagcagctttacaattacctagagatttttctcgttctcctctcatttctgtatcttttaacatggatcctagtttaactctgcctgagtttaaagacttaaaagtatccttgccaccgtcaccaattagttacaccccttttgatctaggatttaacttaattgaacttaatgataacctcattatttactgcaattacaatacagaactatttaaaaaagagacaattaaacaatttcttgaaagctttgaaattttgctgaggggaatcattgacgatgctaatcatctcctttatcagttacctttattaaccccagtccaacaagagaagttactcagacaattaacgggaaaaactcgcaaactccctgaaaaagccaccatcattgatgactttgtagctcaagttaaattaacccctaatgctcccgccttaattgcgggaaaaattagccttagctatcaagaattaaatgaaaaagtcaatcgtcttactcattatttacagcaggaatatcagctaggtgtaggaaaagtgattggggtcatgctccagcgtaatcacaacttaatcatcgggattctggctacctttaaaactggagcgacttacgttcctatagactctcaatatcctcacagtcgcattgagtttattttaaaagatagtggctgtcatgtttgcctaacggagagtaattttatctctaagttacctgaaaaaatggagaaaatttgcttagataaaatcgatcctattgttgaaaaatatgacaaagatgagcctaaaatatttcgcgattctagccaaactgcttatattttttacacttcaggttcaactggtaatcctaaaggagtcatgggccgtcacatctcaattttgaatgttattcaaagcttacgacttacctttgatttagataaacatcctgaatggcgctatattttcacagctgccgttactcatgatccatctattcgtaatatttttctccccttaaccataggtgcatccctatatatgtacgaaataaaatatataggacatttggtttctttcctacaggaaaatcaaattaatgccctacacaccaccccatctatctatcgagaaatcttggggctacttgaaccaggagaaaccatttccagcttaaaatatatctcggtaggaggggaaaaattagatcgggaaactgccttagctttacggaaacgttttccagcagaaattattagcaatgtctacggatctacagaaacttgtgtgggagtatcccagtatgaaatcaaggaaaacttagacagcgaaatccccctcggtcaagttttccataacaatcgcttaggggttcttgatgaatttaataatcccgttcccctccatgtaatcggcgaaatttgtgtagaaggtgccgccctagcatcgggttatcataaccaacccgaaatgactcaagaaaaatttaaacctagctttcttgatgagacaaaaactctctttagaaccggcgatttaggcaagcaaactgctcccggtatcattgagtttatgggacgaaaagataatcaagttaaggtcaatggttatcgaattgaccccggagaaattgaatatcaattgactcgttatgctcccattgaaagagcgattgttttacccgttcaagtgaataatcaaactcaattatctgcttactgtcaaacagacaaaactctagaaattgctgagattcgagaatttcttgccaagtttttgccagtttatatgattcccagttactttatttttttaaagcaattccccttaactcgacatgggaaacttgacctgcactccctgagagaactcaaagaaaccagtaaatctctggttaattctaattatgttgcaccccgtaatcatttagaatccaatctcgttagtatctgggaaaaaattctctctaaacatcctatcggtatttttgataacttctttgaaattggcggtcattctctactcttatcaagggttgtaacccgggttcataaagaactaaatgtatccgtaaaattggctgacttctttaaagttccaaccgttgctggattggcgactttaatctcccagactcaatacaattatcaagaacccatttcggcaattcccccccaaaaatcttatccgatgtctcatggtcagcgtcgtctttgggctttagaattcctagatcaaaatcataatgcttacggaatgcccagtgcttatcaattcaagggcaatctcaatattgacgcttttgaaaatgcctttcaacagttaattcaacgccatgaaattttgcggacaacctttactttaatcaataatcaaccccgtcaagttgtccataatcaaatgaactttgtcattaaacaaatagacctgacagcttatgttagcacagaacaagaaaacttgatcgaagaagcgatcagccataatgccaaaacgacttttgatttagaagtcggaccgttacttaaagttaacttacttaaactaagccaagagaattacatcgtcttgtttaatatgcaccatatcatttctgatggttggtcagcaggggttttaattaaagatttcctcagccattatcacgcctatggacaagaaaattcccaattaatgccccctctcagaattcattataaagactatacttcttggcaagaaagtcaattagaaacctcgaaacttcaagatcaacgggattactggttagctaaattaactcctgtccctgtgcgtcttaacttacctgttgattatctgcgcccacctgttaaaagttttcaaggaaatacaattacatggcaacctgaacccgaattgatcgatacttttgagaagttagttaaagcacaagaagccagtttatttatgggtttagttagtttggttaagagttttctattccgttatactgagcaaaatgaaattacaatcggctctgccatcgccggcagaaatcatcctgatttagaagatcaaatcggattttatgttaacactctcgtcctgcgggatcagatagcagatcacgacagttttacggatgtccttagcaaagtaaaaacaaccactttagaggcttatgataatcaagactatccctttgatcagatcgtatctgatttgaatttacaacgagatcctagccggaatgctctctttgatgtggcaattgtcctgcaaaataatcaaaatatagatctggccttgaacggaattacagtgaactccattgaccccaaaatgatgaccgctaaatttgatttagaatttatctttgttgaggaagaagaactttatctcaagctaatctacaacacagatatatttatccatgagcgaattttattgctcatagatttgttcaaaaactggctagagcaagttttaaaatttgcccatgaacctttgataaacttatccttagcttcctcagaaaatcttattcaagaggggcaggatctgttcacagaagattttaatttttag

SEQ ID NO: 88 - DNA, 10464 bp, Microcystis aeruginosa; identical to SEQ ID NO: 87

SEQ ID NO: 89 - DNA, 7896 bp, Microcystis aeruginosa
gtgtctaagcattcaatcagttttggaggacaattggaagataattggcggactctgtcagaagtcttagaaactgccactaaacataataatcatggaattacttatattaaaaatgacgcagctgaatattttcagagttatcaagacttatatcaagatgctctagttattttaaatggactggaacaaaaggggataaaattagggcataaagttatcctacaaattgccaaaaatcacgactttattcccgcactttgggcttgttttttagggggaattattccagttcctttgaccgttgctcctagctatgatctggaaaattctgccgtcaaaaaactagagaatgtttggaaaattttagacaatcctttgatattatccgatagtgaactaattactgaaattgaaaaattaggaacttactctcatctagaagggtggcaagttatctcagttaatgaactcagaaaagccccctctaaagtccatcaattgccgattcttgatccacaagatccagccttattactctttacttcgggtagtacaggtatgcccaagggagtaatattaactcatcataatattctgtccatgactgctggtacagtggcaatgaaccactttacccaacaagaagttacccttaattggatgcccttagatcatgtaggagctatcgtatttttaggaattatggcggtagatttggcttgtcatcaaattcatgttccgatggaattagtcctacgccaacccctccaatggttagaactcattcaaaagcatcaagtaagcatttcttggtcccctaactttgcattttccttaattaatcaacaggcagaagaacttaagcacgcctcttataacctctcctcaatgaaatttttagtgaatgctggcgagcaagtttcagtaaaaacgattcgcctattcttagaaattcttgaaaaacatcaactacgggagagagcgattaaaccagcttttggcatgactgaatcctgttctgggattacttggtcagccggtttaagtaaaaatgaactcaccgaagaaaatagttttgtctctctaggaaagccgattcctggagcaactatccggatagtcgatcaggaaaataatcctttacctgaaagagaaattggaaagcttcaaattcaaggtaattctgttactaaaggatattacaataatactgaactcaaccaggaagtttttcaagaagggtggtttactacgggagatttggggtatttatttaagggcgaactctttattactgggcgagaaaaacaagaaattataattaatggtgttaattactttgcccatgaacttgaaacaacaatcgaagaattagaaggggttaaagtatcttatacagccgcctttgccgtctttgatcaaagtcgagaaactgacttattaattattacttttagcccagaatctgatcaatttgaacactggataaaagttgttagaaaaattcgcagtcatttgacccaaaaattcggaattgctccagcttatgtcattcccttagaaagaaatttagttcctaaaacctctattggcaaagttcaaaaatctaaattaaaaaaggattttgaacagggattatttagcagccgtatccaagaaatagatcaatatttagcaaaagagcgtcagaaaaatcaaaccttacctcaatcagaaaatgaacgtcaaatagcagcagtttggagtgaagttttacagttaacctcagttggtttagaggataacttctttgaactagggggacattctatacacttaatccgagttcaaaatgaacttgaaaaactttttaaccgtcagctatcccttgctgaaatgtttaaaaatcctaccgttgccaccctagcccgttgcttaagcgaagaatcaaataccactcaagttatagcacaaaaaagccgtcaacgtgccgaaaatcggacccgtcgccataatgaaacccatgacattgcaattattggtatggcggggcaattcccgggagctaaaaatttaacaaccttctgggaaaatttaaaaaatggaatcgaaactatctctttcttttcggaagaagaattacaagaatcgggagtgtcttcggaactctttaatcagcctaattatgttagagctagaccaattctcgagcaagttgaatactttgacagcgaattttttggctatacagatagagaggcagaattactagaccctcagcaacgtttacttcttgaatgtagttgggaatgtttagaaaacgctggttataatcctagtacttatcaaggatcaattggtatatttgctggcgcaagtatgaacacctatttgatcaataattgttatcctaatcggggtcaattagatagtaatgacgagttacaacccttcacactagattcaacgggagggtttcaaacaatggtagctaatgacaaagactatttaacaacgcgaatttcttataaactaaacttacacggcccaagcgttaatgttcaaactgcttgctctactggattagttgtagttcatctcgcctgtcagagtctaattagtggagaaagtgacatggctctagctggagctgcttcaattaattctcctcaaaaaattggttacttatatcaagaaggactgatcatgtctcctgatggtcattgtcgcgcctttgatgctgaagcaaaagggactatttttggcagtggagtaggagtaattctgctcaaaagattgtcagatgctttagccgatcatgaccatatttatgcagttattaaaggctctgctattaataatgatggtggccaaaaattaggatttactgcgcctggtggagagggtcaaattgctgccgctacggaagccctagcctttgccggtgttgatgctaatacaattagttttgtggaagctcatggcacaggaaccccccttggagatcccattgaagttgatgctttagctaaagtttatcagggtgcaaatgagggagaatgtgctttaggttcagtaaaaaccaatatcggacatatgcagattgcttccggtattgctggtttaattaaagcgactttagccctcaaatatagagttattccgcctacattacatttccaaaatcctaaccctcaaattaatttttctcagactcctttttatattaataatgaagctatttcttggactactaagcaagacaaggacgaaaaattaccccgacgggcaggggtaaactctttaggtattggtggggttaatgctcatgttattctagaagaagctcctcccattattcctcaagacaatcagagcaaacgtccctatcatttgctcaccctttccgctcgaaccgaaccggctttgaaagagttagtaagtcgctacatagactttttagaaagtcaacctgaaaaggatatgtctgatgtagtatttacggcaaatacaggccgagttcatttctcaaatcgtttagccttaactggctataaaaacagtgattttattgaacaattacgtcagttcaagcaactagattatcagtcaactattcatggtatagctgatgaaaaaagaccgcctaaaattgcctttttatttacaggacaagggtctcaatatgcagggatggctcatcaactctatcagactcaacccacctttagaaaaactttagacgcaggggaaaactactatcaaaaactaacgggtaaatccctgctaaacgtcgtatttgctgatacagatgaccccttaaaccaaaccgcttatacccaaccggcactatttctgattgaagttgctctcgctcaattatggcattcttggggaattcaaccagccgccattttagggcatagtttaggagaatattctgctgcttgttttgctggcgtttttgatcttgaaagtggcttaaaactggtcacccatcgaggcaacttgatggggcaattaccccaaaatcaaggggaaatggccgctatttttctcgataagaactcagttattgagcagtgccaaagccaaggcataaaaatcgctattgctgccattaacgcggaacaacataccgttatttctggagaaaaaagcgtaattcaagaactctgtaaccatttcactaatgccggggtgaaagttcgtcaactcaaagtttcccatgcttttcactcccctttagtagagccaatggttgcagaatttaaaacgattcttcaagagatttctttcagtcaacctcaaatttctctggtctctaacctaacaggagaaattgctgatgacagcattatgactcctcagtattggcttcaacatttactaaatacggtacaatttcatccaggggctttattcctacaatctctcggatgtgatacctttattgaaattggacctcaacctattctctcaggaattgttcaatcatccctatcttcatctgaacctctaactctacccagtttacgctcaggattttctgattggcaagttttattagaaagtctgggcaaactttatgttcgcggtgcaaagatagactggtttagttttgatcaagactatcatcctagacgatgtgctttacctacttatccctttcaaaaacgtcaacactggattcctttaaaaaccccatctgcaactgttccacaggaatctaatctagtcaaaatgttatctgaaaaggacaaaaatactttgatgcaaaccctcttagaaacaggtcattattctgaagatgaaaaaccaacaatatccgccattgttcaacagttgattaaactctattatcaggaaaaagaggactttaattttgccaaattactttatcaagtagcttggcttccctgggatttagccaacggtaagctacaaaatttgaccccccttaaaactgatttagaggtttacttagaaccccaattacactcctcagaattgatgggagtttctcgcgctttttccgaaatggaaaaactggcagctgactttgttgttaaagctctgaaagatttagaactctttcaaatgaatacctttcttgatcccgatcaaagttttattcaagctgaacttaaacaagaatataaatctttctggaatcatcttctagaaatattggcgaaagtcggcattttagaaaagcaaaataccctatggaaaattgttaaagaacccgaacactctaatcctgatttagcggtagaggatttaatcaatcattatcctaatgctcaaatagaactcaatctatttcgacaagttgccacaaatttagcagccattattacgggaaaaatatctcctttatctatcctattttctcaagatggacaaggaggagccagcgagttttataaaaatacatcttcggcaaaaattctcaatctgggtatctctaaaaccgttgaacttctcctctcaagttatgctccctcagcctccctccgcattctcgaaattggcgcgggaactggagctacaacccaacaggttcttaaagcttgtaagtctcgtcaaattacctacacattcactgatgtttcccccttctttctagagaaagctagagataatttggctgaattttctggactagaatacaaagtactcgatattgaaaaagctccgaaattacaaggtttttgctgccattcttatgacttgattatcgcggctaatgtcttacactctaccgccaatttacaagaggaaaccttgcctcatattcaaagtttactacgtccaggcggtcatttattactgttagaattaactcagcaatctccctggattgatttaatctttggtgtgactcaaggttggtggcgttttagcgattatcatttgcgcccaaatcatcctataattacagcatcgacttgggaatctatgctgcttaaatcggggttttctcaggtagaatttgtttctcctgatcaaaaaataggtagtgttttatttcagcaaagtattattctggctcaaagttcagaaatctcccctaacaccgctaaaaactggctaatttttactgatattgaaccccaacaaaatacttttgccttagggattcaagagcaactacttaaaaagtgtgattcctgtcggataatttatcaaggggagaaaaatacacaaatatcatcttctgagtcttgtttgaatgctaatcaactacaacaattagaggaatggtttgcgtcaaatccatctccagatcggattatttatcttttgaatagtactcccaaagagcaaccagaatccattttattgaatcgctgtaactatcttttaaatcttctcaaagctattcaaacaatccctaatccccctcaattattccttgtcactcagggggcccaaccctttgaattagaacagccttctttagggtttcagtctcctctttgggcaatggggcgtgttattgccctagaaaatccgcaattatggggaggtatgctggatcttgatcccgacgttgatattaatcaaaatattaccgcattactattaggattaactcatgctcacgatgaggatcatttggtcttccgtaaaggtcaaggctatgttgctcgtctgcttcctctcaagtctctagagacaacaaccgttaagattcaaactgaggctacctacctaattacgggaggaataggacatctaggcttagaattggcggaacatttagtcaatttaggagcaaaacatctcattttaacgacacgccgctcattaccggctcgcttcctgtgggattcagcaaccgaattagcccaaatatcagaaaaaatcagaaaattagaggaaaaaggagcatcaatcgaagttatttcggcagacgttggcaattttgaggctatgcaggccatatttacccagattgaaaaaaccgcctatcccttgcgtggcattttccatcttgccggaatctcaggccgacaagctcaattaaaagactgtactttgcaggatctagaagcagtttttcaggcaaaagttaagggttcttggaatttacatcaactatctttgggtactcaattagactattttgtgctgttttcttcggcgggtgcaatttggggggcaaaggaacaaggcttatatgatactgttagtcattggctggatgctttggctcatttccgtcatcttcaacaacttcctgcaacgactttaaattgggcattattggcgggtcatggtatagtgtctcaagactatgaggactggctcaaacagattggcatcagggaaattgctccagatatggccttgagggtgatggatgctattatggcttctaatcaaacacaagttttaatcgctgatgtggattgggttcgtttcaaaaatatctatcaatttaaaggcgagaaaccactcctaaaaaatttaggactctcagaaattcccattaagtctgttcaagaatcagactctgtactgcatcttttagaggatattcctttaggagaacgccgggaatatttgttagaatatgttagcaaacaagtcagaattattttagggattaaatctatgccagattcagaacaaggattgatagaaatggggattgattccttatcctctattgaattgaaaaatcgtttagagaaaggattagaagttctcttacccacttctttaatctttgactttcctaatattagacgcttagttgattatctgtttgaccgtattttcggtgaaaaagttcaaaaaacagccgagaagatgattaacttcactgaagttcagcaggagattagtgaggatttaatcttacaagaacttactgatttggaggcttttttaggagattaa

SEQ ID NO: 90 - DNA, 7896 bp, Microcystis aeruginosa; identical to SEQ ID NO: 89

SEQ ID NO: 91 - DNA, 1758 bp, Microcystis aeruginosa
atgcaaactccattttttcaacaagaaaccgtaaaaagttctcatcaattttttgataatttgaaattgattgccgctccttactggtatccaaccgatcctaaaggaaggacattttcagaggtaataagttcatggggaatgctgtttctccttgttttagtaattgttggactggttgcctctaatgcagttaatagcttcgttaatcgctatttagttgatgttattattcaagataaaaatgcctctaagtttctgacaattttattattttatggcttaggattacttttaattaccctgtttactgcattttctaaatttgttaaaaaaagaattattctggattggtatgaatggctaaatcagcaggttattacccaatatttgagcgatcgcgcctattataaaattaattttagatccgatgtggataatccggatcaaaggatagcccaagaaatagaacccattgctagaaatgctgttaattttggagctattttattagaaaaagtcttagaaatgacgacttttttagtaattcttttctcaatttcccgactagccgccttgattttagtggcttatacaattatcggcaacctaattgctgtttctttaagtcgagaattagataagattagtcaagaagaattggaatccaaagctaattacacctacactttaactcatgttcgtaatcatgctgaatctattgccttttttcaaggcgaaaatcaagagttgaaaatcattcaacgtcgatttaataatctcgtcagaaattctctcagtaagattgattgggagaaaaatcaagacatttttagtcgaagttatcgctcagttattcaaatatttccctttgtcgtcttcgctccagcctatattcggggggaaattgatttcggacaagttaatcaggctattattgcttgcagtatgtttgctaatggtttttctgagttaatccttgaatttggttctttgggcagattttccagttatgttgagcgtctatctgaattttcctcggccttagaagaaatggaccgacaacccaaggatgctagtaccattaaaacccttgaacaaaatgagatcgagtttgaggatgttactttacaaacaccggattatgaaaaggtaattgttcaacatttatccctatctatcgaaccaggcgaaggtttattaattgtcggaccgagtggacgaggtaaaagttctctattaagagctattgctggcttatggaatgcaggaactggttgtttaaaacgacctcccttagaagaatttctctttttacctcaacgtccttatattattttaggaactctaagagaacagttactttatcctaaaacaacccgtgaaatgaccgatggagaacttgaatccgttttacaacaagttaatcttcaaaatatagccacaaaagttcatggctttgatgcggaagttccttgggaaaatatattatctttaggagaacaacaacgccttgcttttgcacgattgttagtaacccatccccgctatgtaatcttagatgaagccacaagtgctttagatttgaacaacgaacaaaccttatatcaccagttacaaaaagcacagacaacttttattagcgtaggtcatcgagaaagtttatttaagtatcatcaatgggtcttagaacttttagaggattctagttggcgacttgtttccatagatgattatcgagcctcaaaatctctgtaa

SEQ ID NO: 92 - DNA, 1758 bp, Microcystis aeruginosa; identical to SEQ ID NO: 91

SEQ ID NO: 93 - DNA, 846 bp, Microcystis aeruginosa
atggcgtttttgcaagatcagtttcaagtttctgaactgtatactaatatagcgaaacgcgatcctcatcttcatgatcctaattttccccaatggcttaattttggttattggcaagaagaaacaacttataacggagcttgtgccgctttagcgcgtaaattagccgaagtagccgaacttaaagccggagatcaccttttggatgtgggtttcggttttgctgaacaggatttactctgggtaagagaaaacaatgttggctcaattatcggtctaaatacaaccgagttacaagtagaaattgctcaagaaagagtagctaaagcagggttatcggacaggataaaacttcaagtcggctcggctactcaaataccttttcctgagaattcttttgataagttgaccgctttagaatgtgcttttcattttgacactcgtgaggatttttttgcggaagcttttcgagttttgcagcccggtggaaggttggctatagcggattgtttgcctagagtgggtcgagaaattaacttctggctgcgggttaatagtaagaaaatgtgtattccctttgctaatcaatacgaccgacatacttatgtggaaaaactcaaaaagcatggatttgttaatatccaagctttatctattagtgaatatgtttggccggcaatggttcattattttgcccagattagccaaggaattagtaagcatgatttagttatcgatctccagaaagataaccctggacttgaagcttggtcaagaaatcggggttggtttatggcgtttgatgattatcttttgttttcggcagaaaagcctaaattaaactga

SEQ ID NO: 94 - DNA, 846 bp, Microcystis aeruginosa; identical to SEQ ID NO: 93

SEQ ID NO: 95 - DNA, 3788 bp, Microcystis viridis
aatgtcaccattccggcccgggccctgcgagaattggaaagaatgatggcaacaaaacaaaatatcgagactattactctgcatgtggatgattctcaagtcatctttgaaatgggggaacagaggttaaccagtcgtaagttagaaggggcctatcccacttataatcagttaattcctaaatccttcgatcgctctttggttttagaccgcaaacaattaatccgttgtttggaattagtggcggttttatcggaccaaaagaataacttagtcaagtttagcctcgatagcgaaaatgaccgtttatccctagcggtggagtctcccgatttaggtagtgccaaagagtccatggcggcggaaattcagggagaaagtggcgatattgcctttaatgttaaatatttgatggacggtttgaaggctttacccaataatgatatccaaatgcagttaaatgctagtacccaaccggttatttttacccccttgggaggtttaaagatgacctatttggtgatgccggtacaaattcgtcagtaattctgacttaatcgagaccgtgggatgtgtttttaacctatcccatttttgattgtaagtagctggttataattaaattgaagatagattttgggttcgatccccccttaatccccccttgataaggggggtgtcgatccccccttaatccccccttgataagctatccattagtcggatctttcttaacaaaaagagaagaaacttaaaaaaaggggaaacgattgataggtatagttttgaaagaaggaattaaggtggaggtaagcaaaaaaatggagaaatgggcagcccaagaattacagtatgcagacctaggggacaccagaagaaagaaaaggttaatcagcatcgtagaaaacttggccagccaacctagtacaagtgtgccacaagcctcgggaaatctagccgcagcgagtgccacctacgacttttggaattccccctattttcacccgtcagatataattgccgcccaagctaaaagtacagtagaaagaatcaaagaacatccaatagttttagcagtgcaagacacaacaagtttagactttacgacccaaaaagccaaaaaaggaatgggttatctagattataaaaaatcctttggtctcaaagttcataccacattaggagtgtcagcgcaaggaatacctttaggactgattaatcaatatgtctgggcaagagaagaaaagaatttagggattgccaagcaaagaaaaaaaagagaaaccgaagaaaaagaaagtcaaagatggttagattctttatcagaaacacaacaacaaatacccgaagatattcaagtagtaacaatcggagattgtgaggcagacatatttgatttatttgcccaatcaagaagtcctaactctcatttattaatccgaggaactcataaccgaaaagttaactatctcgaagacaagcaaaggtcagggcatccagagcctaaatatttacatcaatccatcagagaagttaaagcctgtggtagcctagatgtgcaagtaaaacgcaatcctaatcacgaggctagactagctaaactaacagttagatttgccagttttgaaatacaagtacctaagcatcactcgaaagcgaaccctcgtcaaccggtcaaattacaggtaattttagctgaagaagaaaagccgcgtcccggagttaatcctatcagttggctcctcttaactagcctagacattagtagctttgaatcggcgataacctgtgtgcgctggtatagttatcgctggttaatagaacgctatcattttgttttaaaaagtggttgtggattagaaaaactgcaattagaaacgggtcgtagaattgagatggccttagctacctattcaattgtagcttggagattactttggttaacctatcaagcacgcttacacggagaggagagttgtgaaagttttttggaagaacatgaatggcaatctttgtgtgccactattcataaaaagagtccgccacctgaaaagccgccctcctttcgagaagcggtcagaatgattgcttctcttggggggtttttaggtagaaaaggtgacggtgaaccaggtgttaaaactatttggttgggactgcgaaggttacatgatatcagccagacttggaaactatctcatcaaattagtccccccatagaacccccttgagccatcttgcacacttttctctttttgtcaaattttatgttaagaaagatgtgactaatggatagcttgataaggggggtgtcgatccccccttaatccccccttgataaggggggtgtcgatccccccttaatccccccttgataaggggggtgtctgatagtttttaacgcctaactacttattaactcaatcctattttctcgccaaaggattgggtttattctctctattttggcgatatactgttgataattgaacaacttcacggattgaatggatatcttatactaaatccggttattaaagactgattatttattcccacttttgccttttgcatgagtgcctgtcctgatatgtagcctatactaagctgttcgtaatttaaattgcttgttgagacgaggcaagaggcaaaaggcaacagtaaagggattggaggaggttcggctaatctaagaataagcggtttaaatgcgtcttagcttaacaagaagtcctccctaccgatggactgggttttacatcaatctgcttaaaccgaactcagtttaatttaggcttttctgccgaaaacaaaagataatcatcaaacgccataaaccaaccccgatttcttgaccaagcttcaagtccagggttatctttctggagatcgataactaaatcatgcttactaattccttggctaatctgggcaaaataatgaaccattgccggccaaacatattcactaatagataaagcttggatattaacaaatccatgctttttgagtttttctacataagtatgtcggtcgtattgattagcaaagggaatacacattttcttactattaacccgcagccagaagttaatttctcgacccactctaggcaaacaatccgctatagccaaccttccaccgggctgcaaaactcgaaaagcttccgcaaaaaaatcctcacgagtgtcaaaatgaaaagcacattctaaagcggtcaacttatcaaaagaattctcaggaaaaggtatttgagtagccgagcctacttgaagttttatcctgtccgataaccctgctttagctactctttcttgagcaatttctacttgtaactcagttgtatttagaccgataattgagccaacattgttttctcttacccagagtaaatcctgttcagcaaaaccgaaacccacatccaaaaggtgatctccggctttaagttcggctacttcggctaatttacgcgctaaagcggcacaagctccgttataagttgtttcttcttgccaataaccaaaattaagccattggggaaaattaggatcatgaagatgaggatcgcgtttcgctatattagtatacagttcagaaacttgaaactgatcttgcaaaaacgccatttctcgaaccggattaaggataaattgtttgatggttgcccagcgattacgccattcatctttgaggggaattttgccgatgttttccaaattattatcctcctaaggattttgcagaaatattgccatttttaattaaccgaatccctgagattctctaga

SEQ ID NO: 96 - DNA, 57817 bp, Anabaena sp. 90; identical to SEQ ID NO: 72

The invention claimed is:

1. A recombinant cell for producing microcystin comprising:
a single exogenous polynucleotide encoding each of:
a microcystin A polypeptide (mcyA),
a microcystin B polypeptide (mcyB),
a microcystin C polypeptide (mcyC),
a microcystin D polypeptide (mcyD),
a microcystin E polypeptide (mcyE),
a microcystin G polypeptide (mcyG), and
a microcystin H polypeptide (mcyH),
and optionally any one or more of:
a microcystin F polypeptide (mcyF),
a microcystin I polypeptide (mcyI),
a microcystin J polypeptide (mcyJ),
a microcystin L polypeptide (mcyL), and
a microcystin T polypeptide (mcyT),
wherein said exogenous polynucleotide further comprises an exogenous promoter operably connected to the exogenous polynucleotide,
or
multiple exogenous polynucleotides collectively encoding each of:
a microcystin A polypeptide (mcyA),
a microcystin B polypeptide (mcyB),
a microcystin C polypeptide (mcyC),
a microcystin D polypeptide (mcyD),
a microcystin E polypeptide (mcyE),
a microcystin G polypeptide (mcyG), and
a microcystin H polypeptide (mcyH),
and optionally any one or more of:
a microcystin F polypeptide (mcyF),
a microcystin I polypeptide (mcyI),
a microcystin J polypeptide (mcyJ),
a microcystin L polypeptide (mcyL), and
a microcystin T polypeptide (mcyT),
wherein each of said multiple exogenous polynucleotides further comprises at least one exogenous promoter operably connected to the exogenous polynucleotide; and
(ii) an exogenous polynucleotide encoding phosphopantethienyl transferase (PPT).

2. The recombinant cell of claim 1, wherein the single exogenous polynucleotide encodes each of:
a microcystin A polypeptide (mcyA),
a microcystin B polypeptide (mcyB),
a microcystin C polypeptide (mcyC),
a microcystin D polypeptide (mcyD),
a microcystin E polypeptide (mcyE),
a microcystin F polypeptide (mcyF),
a microcystin G polypeptide (mcyG),
a microcystin H polypeptide (mcyH),
a microcystin I polypeptide (mcyI), and
a microcystin J polypeptide (mcyJ)
or
the multiple exogenous polynucleotides collectively encode each of:
a microcystin A polypeptide (mcyA),
a microcystin B polypeptide (mcyB),
a microcystin C polypeptide (mcyC),
a microcystin D polypeptide (mcyD),
a microcystin E polypeptide (mcyE),
a microcystin F polypeptide (mcyF),
a microcystin G polypeptide (mcyG),
a microcystin H polypeptide (mcyH),
a microcystin I polypeptide (mcyI), and
a microcystin J polypeptide (mcyJ).

3. The recombinant cell of claim 1, wherein the single exogenous polynucleotide encodes each of:
a microcystin A polypeptide (mcyA),
a microcystin B polypeptide (mcyB),
a microcystin C polypeptide (mcyC),
a microcystin D polypeptide (mcyD),
a microcystin E polypeptide (mcyE),
a microcystin G polypeptide (mcyG), and
a microcystin H polypeptide (mcyH),
a microcystin J polypeptide (mcyJ), and
a microcystin T polypeptide (mcyT),
or
the multiple exogenous polynucleotides collectively encode each of:
a microcystin A polypeptide (mcyA),
a microcystin B polypeptide (mcyB),
a microcystin C polypeptide (mcyC),
a microcystin D polypeptide (mcyD),
a microcystin E polypeptide (mcyE),
a microcystin G polypeptide (mcyG), and
a microcystin H polypeptide (mcyH),
a microcystin J polypeptide (mcyJ), and
a microcystin T polypeptide (mcyT)
or
wherein the single exogenous polynucleotide encodes each of:
a microcystin A polypeptide (mcyA),
a microcystin B polypeptide (mcyB),
a microcystin C polypeptide (mcyC),
a microcystin D polypeptide (mcyD),
a microcystin E polypeptide (mcyE),
a microcystin F polypeptide (mcyF),
a microcystin G polypeptide (mcyG),
a microcystin H polypeptide (mcyH), and
a microcystin L polypeptide (mcyL), or
the multiple exogenous polynucleotides collectively encode each of:
a microcystin A polypeptide (mcyA),
a microcystin B polypeptide (mcyB),
a microcystin C polypeptide (mcyC),
a microcystin D polypeptide (mcyD),
a microcystin E polypeptide (mcyE),
a microcystin F polypeptide (mcyF),
a microcystin G polypeptide (mcyG),
a microcystin H polypeptide (mcyH), and
a microcystin L polypeptide (mcyL).

4. The recombinant cell of claim 1 wherein when the cell comprises the multiple exogenous polynucleotides, the multiple exogenous polynucleotides comprise:
(i) a first exogenous polynucleotide encoding each of:
a microcystin A polypeptide (mcyA),
a microcystin B polypeptide (mcyB),
a microcystin C polypeptide (mcyC); and
a second exogenous polynucleotide encoding each of:
a microcystin D polypeptide (mcyD),
a microcystin E polypeptide (mcyE),
a microcystin F polypeptide (mcyF),
a microcystin G polypeptide (mcyG),
a microcystin H polypeptide (mcyH),
a microcystin I polypeptide (mcyI), and
a microcystin J polypeptide (mcyJ);
or
(ii) a first exogenous polynucleotide encoding each of:
a microcystin A polypeptide (mcyA),
a microcystin B polypeptide (mcyB), and
a microcystin C polypeptide (mcyC);
a second exogenous polynucleotide encoding:
a microcystin J polypeptide (mcyJ);
a third exogenous polynucleotide encoding each of:
a microcystin D polypeptide (mcyD),
a microcystin E polypeptide (mcyE),
a microcystin G polypeptide (mcyG),
a microcystin H polypeptide (mcyH); and
a fourth exogenous polynucleotide encoding:
a microcystin T polypeptide (mcyT);
or
(iii) a first exogenous polynucleotide encoding each of:
a microcystin A polypeptide (mcyA),
a microcystin B polypeptide (mcyB), and
a microcystin C polypeptide (mcyC); and
a second exogenous polynucleotide encoding each of:
a microcystin D polypeptide (mcyD),
a microcystin E polypeptide (mcyE),
a microcystin F polypeptide (mcyF),
a microcystin G polypeptide (mcyG),
a microcystin H polypeptide (mcyH), and
a microcystin L polypeptide (mcyL).

5. The recombinant cell of claim 1, wherein the single exogenous polynucleotides is within a vector or the multiple exogenous polynucleotides collectively encoding the microcystin polypeptides are within vectors, optionally wherein the vector or series of vectors are plasmids.

6. The recombinant cell of claim 1 wherein when the cell comprises the multiple exogenous polynucleotides collectively encoding the microcystin polypeptides, an exogenous polynucleotide encoding two or more microcystin polypeptides further comprises an intervening sequence between the encoded two or more microcystin polypeptides.

7. The recombinant cell of claim 6, wherein the intervening nucleotides are the exogenous promoter.

8. The recombinant cell of claim 1, wherein the exogenous promoter:
(i) is not a T7 polymerase promoter; and/or
(ii) is one or more of an inducible promoter, an antibiotic-inducible promoter, and/or a tetracycline-inducible promoter; and/or
(iii) is a processive promoter capable of facilitating production of mRNA transcripts of at least 5 kb in length; and/or
(iv) is a bi-directional promoter; and/or
(v) is PtetO.

9. The recombinant cell of claim 1, wherein the exogenous PPT:
(i) is capable of activating type I and type II acyl carrier proteins (ACP) and peptidyl carrier proteins (PCP); and/or
(ii) is a bacterial PPT, a cyanobacterial PPT, a *Bacillus* PPT, a myxobacterial PPT, an actinobacterial PPT, a *Pseudomonas* PPT, a *Nodularia* PPT, a *Stigmatella* PPT, or a *Stigmatella aurantiaca* DW43-1 MtaA PPT.

10. The recombinant cell of claim 1, wherein the exogenous polynucleotide sequence encoding the PPT is integrated into the recombinant cell genome.

11. The recombinant cell of claim 1, wherein the recombinant cell is a recombinant prokaryotic cell, a recombinant bacterial cell, a recombinant Enterobacteriaceae family cell, a recombinant cell, or a recombinant *Escherichia coli* cell.

12. The recombinant cell of claim 1, wherein the recombinant cell:
(i) is not a eukaryotic cell, a cyanobacterium, a dinoflagellate, a yeast, a human cell, a mammalian cell, or a plant cell; and/or
(ii) does not comprise additional cyanotoxin, or any one or more of cylindrospermopsin, anatoxin, homoanatoxin, saxitoxin, neosaxitoxin, lyngbyatoxin, erythromycin, aplysiatoxin, and/or nodularin.

13. The recombinant cell of claim 1, wherein the recombinant cell does not comprise:
(i) any polyketide that is not a microcystin; and/or
(ii) a polynucleotide encoding 6-deoxyerythronolide B synthase or a catalytic domain thereof.

14. A vector for producing microcystin comprising:
(i) a single polynucleotide encoding each of:
a microcystin A polypeptide (mcyA),
a microcystin B polypeptide (mcyB),
a microcystin C polypeptide (mcyC),
a microcystin D polypeptide (mcyD),
a microcystin E polypeptide (mcyE),
a microcystin G polypeptide (mcyG), and
a microcystin H polypeptide (mcyH),
and optionally any one or more of:
a microcystin F polypeptide (mcyF),
a microcystin I polypeptide (mcyI),
a microcystin J polypeptide (mcyJ),
a microcystin L polypeptide (mcyL), and
a microcystin T polypeptide (mcyT),
(ii) a promoter operably connected with the polynucleotide; and
(iii) a polynucleotide encoding phosphopantetheinyl transferase (PPT).

15. The vector of claim 14, wherein the polynucleotide encodes each of:
a microcystin A polypeptide (mcyA),
a microcystin B polypeptide (mcyB),
a microcystin C polypeptide (mcyC),
a microcystin D polypeptide (mcyD),
a microcystin E polypeptide (mcyE), a microcystin F polypeptide (mcyF),
a microcystin G polypeptide (mcyG),
a microcystin H polypeptide (mcyH),
a microcystin I polypeptide (mcyI), and
a microcystin J polypeptide (mcyJ).

16. The vector of claim 14, wherein the polynucleotide encodes each of:
a microcystin A polypeptide (mcyA),
a microcystin B polypeptide (mcyB),
a microcystin C polypeptide (mcyC),
a microcystin D polypeptide (mcyD),
a microcystin E polypeptide (mcyE),
a microcystin G polypeptide (mcyG),
a microcystin H polypeptide (mcyH),
a microcystin J polypeptide (mcyJ), and
a microcystin T polypeptide (mcyT),
or wherein the polynucleotide encodes each of:
a microcystin A polypeptide (mcyA),
a microcystin B polypeptide (mcyB),
a microcystin C polypeptide (mcyC),
a microcystin D polypeptide (mcyD),
a microcystin E polypeptide (mcyE),
a microcystin F polypeptide (mcyF),
a microcystin G polypeptide (mcyG),
a microcystin H polypeptide (mcyH), and
a microcystin L polypeptide (mcyL).

17. The vector of claim 14, wherein the vector is a plasmid.

18. The vector of claim 17, wherein the plasmid is capable of conferring resistance to only one antibiotic.

19. A method for generating a recombinant cell capable of producing microcystin, the method comprising transforming a parent cell with:
(i) a single exogenous polynucleotide encoding each of:
a microcystin A polypeptide (mcyA),
a microcystin B polypeptide (mcyB),
a microcystin C polypeptide (mcyC),
a microcystin D polypeptide (mcyD),
a microcystin E polypeptide (mcyE),
a microcystin G polypeptide (mcyG), and
a microcystin H polypeptide (mcyH),
and optionally any one or more of:
a microcystin F polypeptide (mcyF),
a microcystin I polypeptide (mcyI),
a microcystin J polypeptide (mcyJ),
a microcystin L polypeptide (mcyL), and
a microcystin T polypeptide (mcyT),
wherein said exogenous polynucleotide further comprises an exogenous promoter operably connected to the encoded exogenous polynucleotide,
or
multiple exogenous polynucleotides collectively encoding each of:
a microcystin A polypeptide (mcyA),
a microcystin B polypeptide (mcyB),
a microcystin C polypeptide (mcyC),
a microcystin D polypeptide (mcyD),
a microcystin E polypeptide (mcyE),
a microcystin G polypeptide (mcyG), and
a microcystin H polypeptide (mcyH),
and optionally any one or more of:
a microcystin F polypeptide (mcyF),
a microcystin I polypeptide (mcyI),
a microcystin J polypeptide (mcyJ),
a microcystin L polypeptide (mcyL), and
a microcystin T polypeptide (mcyT),
wherein each of said multiple exogenous polynucleotides further comprises at least one exogenous promoter operably connected to the exogenous polynucleotide; and
(ii) an exogenous polynucleotide encoding phosphopantethienyl transferase (PPT).

20. The method of claim 19, wherein the single exogenous polynucleotides is within a vector or multiple exogenous polynucleotides collectively encoding the microcystin polypeptides are within vector.

21. A method for producing microcystin, the method comprising: culturing the recombinant cell of claim 1 in a suitable culture medium and for a suitable time period to facilitate production of the microcystin, and optionally isolating the microcystin produced by the cells during or following the culturing.

* * * * *